US012606627B2

(12) United States Patent
Zhu et al.

(10) Patent No.: US 12,606,627 B2
(45) Date of Patent: Apr. 21, 2026

(54) α4β7 INTEGRIN BINDING PROTEINS AND METHODS OF USE

(71) Applicant: Paragon Therapeutics, Inc., Waltham, MA (US)

(72) Inventors: Eric Franklin Zhu, Waltham, MA (US); Hussam Hisham Shaheen, Waltham, MA (US); Jacob Cole Milligan, Waltham, MA (US)

(73) Assignee: Paragon Therapeutics, Inc., Waltham, MA (US)

( * ) Notice: Subject to any disclaimer, the term of this patent is extended or adjusted under 35 U.S.C. 154(b) by 0 days.

(21) Appl. No.: 19/245,760

(22) Filed: Jun. 23, 2025

(65) Prior Publication Data

US 2025/0313636 A1      Oct. 9, 2025

Related U.S. Application Data

(63) Continuation of application No. PCT/US2024/042242, filed on Aug. 14, 2024.

(60) Provisional application No. 63/519,483, filed on Aug. 14, 2023.

(51) Int. Cl.
C07K 16/28 (2006.01)

(52) U.S. Cl.
CPC ...... C07K 16/2839 (2013.01); C07K 2317/24 (2013.01); C07K 2317/565 (2013.01); C07K 2317/72 (2013.01); C07K 2317/92 (2013.01); C07K 2317/94 (2013.01)

(58) Field of Classification Search
None
See application file for complete search history.

(56) References Cited

U.S. PATENT DOCUMENTS

| | | | |
|---|---|---|---|
| 5,811,523 A | 9/1998 | Trinchieri et al. |
| 5,840,299 A | 11/1998 | Bendig et al. |
| 7,083,784 B2 | 8/2006 | Dall'Acqua et al. |
| 7,090,845 B2 | 8/2006 | Fong et al. |
| 7,147,851 B1 | 12/2006 | Ponath et al. |
| 7,211,252 B2 | 5/2007 | Mundy et al. |
| 7,402,410 B2 | 7/2008 | Ponath et al. |
| 7,435,802 B2 | 10/2008 | Bendig et al. |
| 7,528,236 B2 | 5/2009 | Fong et al. |
| 7,682,613 B2 | 3/2010 | Fabene et al. |
| 7,687,605 B2 | 3/2010 | Fong et al. |
| 7,803,904 B2 | 9/2010 | Briskin et al. |
| 8,124,082 B2 | 2/2012 | Fong et al. |
| 8,246,958 B2 | 8/2012 | Bendig et al. |
| 8,444,981 B2 | 5/2013 | Hsu et al. |
| 8,449,489 B2 | 5/2013 | Thorn et al. |
| 8,454,961 B2 | 6/2013 | Hsu et al. |
| 8,454,962 B2 | 6/2013 | Hsu et al. |
| 8,722,019 B2 | 5/2014 | Jefferies et al. |
| 8,871,490 B2 | 10/2014 | Hsu et al. |

| | | | |
|---|---|---|---|
| 8,962,804 B2 | 2/2015 | Williams et al. |
| 9,028,815 B2 | 5/2015 | Stavenhagen et al. |
| 9,040,295 B2 | 5/2015 | Kon et al. |
| 9,193,790 B2 | 11/2015 | Arthos et al. |
| 9,364,567 B2 | 6/2016 | Vitalis et al. |
| 9,441,041 B2 | 9/2016 | Arthos et al. |
| 9,499,620 B2 | 11/2016 | Hsu et al. |
| 9,662,490 B2 | 5/2017 | Tracey et al. |
| 9,663,579 B2 | 5/2017 | Fox et al. |
| 9,678,071 B2 | 6/2017 | Escalante et al. |
| 9,717,453 B2 | 8/2017 | Cadavid et al. |
| 9,764,033 B2 | 9/2017 | Diluzio et al. |
| 9,821,049 B2 | 11/2017 | Richardson et al. |
| 9,873,742 B2 | 1/2018 | Keir et al. |
| 9,896,509 B2 | 2/2018 | Arthos et al. |
| 9,914,779 B2 | 3/2018 | Borie et al. |
| 9,976,166 B2 | 5/2018 | Schellenberger et al. |
| 10,004,808 B2 | 6/2018 | Fox et al. |
| 10,040,855 B2 | 8/2018 | Diluzio et al. |
| 10,143,752 B2 | 12/2018 | Fox et al. |
| 10,221,251 B2 | 3/2019 | Humphreys et al. |
| 10,273,542 B2 | 4/2019 | Hackney et al. |
| 10,324,088 B2 | 6/2019 | Singh et al. |
| 10,519,228 B2 | 12/2019 | Srinivasan et al. |
| 10,532,051 B2 | 1/2020 | Ebsworth et al. |
| 10,654,931 B2 | 5/2020 | Hosen et al. |
| 10,669,587 B2 | 6/2020 | Hackney et al. |
| 10,844,416 B2 | 11/2020 | Tescione et al. |
| 10,918,716 B2 | 2/2021 | Lissoos et al. |
| 10,947,254 B2 | 3/2021 | Hudson et al. |
| 10,981,965 B2 | 4/2021 | Mumm |
| 10,981,966 B2 | 4/2021 | Mumm |

(Continued)

FOREIGN PATENT DOCUMENTS

| | | |
|---|---|---|
| BR | 102020016890 A2 | 5/2022 |
| EP | 1173201 B1 | 6/2005 |

(Continued)

OTHER PUBLICATIONS

Varkas et al. An induction or flare of arthritis and/or sacroiliitis by vedolizumab in inflammatory bowel disease: a case series. Ann Rheum Dis 2017;76:878-881. doi:10.1136/annrheumdis-2016-210233. (Year: 2017).*

Cortes et al. Expert perspectives on biosimilar monoclonal antibodies in breast cancer. Breast Cancer Res Treat (2014) 144:233-239. (Year: 2014).*

Aliprantis et al., "A Phase 1 Randomized, Double-Blind, Placebo-Controlled Trial to Assess the Safety, Tolerability, and Pharmacokinetics of a Respiratory Syncytial Virus Neutralizing Monoclonal Antibody MK-1654 in Healthy Adults", Clinical Pharm in Drug Development, vol. 10, No. 5, pp. 556-566, 2021.

Arijs et al., "Effect of Vedolizumab (anti-α4β7-integrin) Therapy on Histological Healing and Mucosal Gene Expression in Patients with UC", Gut Published Online First: Oct. 7, 2016 doi:10.1136/gutjnl-2016-312293.

(Continued)

*Primary Examiner* — Maher M Haddad

(74) *Attorney, Agent, or Firm* — Greenberg Traurig, LLP; Prashant Girinath; Natalie Salem

(57) ABSTRACT

Provided herein are α4β7 binding proteins (e.g., antibodies that bind α4β7) and methods of use.

15 Claims, 2 Drawing Sheets

Specification includes a Sequence Listing.

(56) References Cited

U.S. PATENT DOCUMENTS

| 10,988,540 | B2 | 4/2021 | Hosen et al. |
| 11,045,469 | B2 | 6/2021 | Campbell et al. |
| 11,053,303 | B2 | 7/2021 | Lebert et al. |
| 11,059,911 | B2 | 7/2021 | Humphreys et al. |
| 11,091,551 | B2 | 8/2021 | Keir et al. |
| 11,261,493 | B2 | 3/2022 | Hackney et al. |
| 11,268,119 | B2 | 3/2022 | Mitchelson et al. |
| 11,286,308 | B2 | 3/2022 | Waldman et al. |
| 11,377,499 | B2 | 7/2022 | Wu |
| 11,389,533 | B2 | 7/2022 | Rosario et al. |
| 11,560,434 | B2 | 1/2023 | Diluzio et al. |
| 11,596,688 | B2 | 3/2023 | Rosario et al. |
| 11,639,390 | B2 | 5/2023 | Min et al. |
| 11,753,668 | B2 | 9/2023 | Mitchelson et al. |
| 11,760,803 | B2 | 9/2023 | Brake et al. |
| 11,780,852 | B2 | 10/2023 | Hudson et al. |
| 11,806,507 | B2 | 11/2023 | Herzlinger |
| 11,884,731 | B2 | 1/2024 | Lasch |
| 11,911,409 | B2 | 2/2024 | Yoneyama |
| 11,987,620 | B2 | 5/2024 | Johnson et al. |
| 11,999,791 | B2 | 6/2024 | Kao et al. |
| 12,024,561 | B2 | 7/2024 | Jayaraman et al. |
| 12,030,948 | B2 | 7/2024 | Jayaraman et al. |
| 12,053,526 | B2 | 8/2024 | Scholz et al. |
| 12,103,975 | B2 | 10/2024 | Gawlitzek et al. |
| 12,133,966 | B2 | 11/2024 | Herzlinger |
| 12,171,832 | B2 | 12/2024 | Fox et al. |
| 12,174,200 | B2 | 12/2024 | M'Koma |
| 12,246,064 | B2 | 3/2025 | Lissoos et al. |
| 12,286,479 | B2 | 4/2025 | Fox et al. |
| 12,304,956 | B1 | 5/2025 | Harwin et al. |
| 2001/0046496 | A1 | 11/2001 | Brettman et al. |
| 2002/0197233 | A1 | 12/2002 | Relton et al. |
| 2004/0132642 | A1 | 7/2004 | Hwang |
| 2005/0053598 | A1 | 3/2005 | Burke et al. |
| 2005/0074451 | A1 | 4/2005 | Yednock et al. |
| 2005/0095238 | A1 | 5/2005 | Brettman et al. |
| 2005/0233387 | A1 | 10/2005 | Artis et al. |
| 2005/0255118 | A1 | 11/2005 | Wehner |
| 2005/0260193 | A1 | 11/2005 | Lieberburg |
| 2005/0276803 | A1 | 12/2005 | Chan et al. |
| 2006/0029600 | A1 | 2/2006 | Rubin et al. |
| 2006/0128607 | A1 | 6/2006 | Bosserhoff et al. |
| 2006/0234306 | A1 | 10/2006 | Artis et al. |
| 2007/0048219 | A1 | 3/2007 | Hsei et al. |
| 2007/0122403 | A1 | 5/2007 | Dall'Acqua et al. |
| 2007/0122404 | A1 | 5/2007 | O'Keefe |
| 2008/0075719 | A1 | 3/2008 | Chan et al. |
| 2008/0153756 | A1 | 6/2008 | Krissansen et al. |
| 2009/0011464 | A1 | 1/2009 | Ponath et al. |
| 2009/0208492 | A1 | 8/2009 | O'Connor et al. |
| 2009/0214527 | A1 | 8/2009 | Burgess et al. |
| 2009/0217392 | A1 | 8/2009 | Giles-Komar et al. |
| 2009/0263421 | A1 | 10/2009 | Spetz-Holmgren et al. |
| 2009/0298195 | A1 | 12/2009 | Ruker et al. |
| 2010/0119517 | A1 | 5/2010 | Burgess et al. |
| 2010/0129353 | A1 | 5/2010 | DeLuca |
| 2010/0247431 | A1 | 9/2010 | Armour et al. |
| 2010/0255508 | A1 | 10/2010 | Gelzleichter et al. |
| 2010/0266587 | A1 | 10/2010 | McLachlan |
| 2010/0266636 | A1 | 10/2010 | Richardson et al. |
| 2010/0267934 | A1 | 10/2010 | VandeWinkel et al. |
| 2010/0297699 | A1 | 11/2010 | Li et al. |
| 2011/0002851 | A1 | 1/2011 | Haas et al. |
| 2011/0158982 | A1 | 6/2011 | Segal et al. |
| 2012/0034243 | A1 | 2/2012 | Brettman et al. |
| 2012/0039907 | A1 | 2/2012 | Armour et al. |
| 2012/0121580 | A1 | 5/2012 | Bhambhani et al. |
| 2012/0282249 | A1 | 11/2012 | Fox et al. |
| 2013/0052642 | A1 | 2/2013 | Alvarez et al. |
| 2013/0059337 | A1 | 3/2013 | Bendig et al. |
| 2013/0108617 | A1 | 5/2013 | Kappos et al. |
| 2013/0109032 | A1 | 5/2013 | Gelzleichter et al. |
| 2013/0337470 | A1 | 12/2013 | Chackerian |
| 2014/0004130 | A1 | 1/2014 | Bordignon |
| 2014/0080762 | A1 | 3/2014 | Hazlehurst et al. |
| 2014/0120084 | A1 | 5/2014 | Anand et al. |
| 2014/0135483 | A1 | 5/2014 | Seito et al. |
| 2014/0154252 | A1 | 6/2014 | Thompson et al. |
| 2014/0170157 | A1 | 6/2014 | Agarwal et al. |
| 2014/0186345 | A1 | 7/2014 | Brettman et al. |
| 2014/0212425 | A1 | 7/2014 | Chang et al. |
| 2014/0377253 | A1 | 12/2014 | Harding et al. |
| 2015/0010563 | A1 | 1/2015 | Hamrah et al. |
| 2015/0056205 | A1 | 2/2015 | Lieberburg |
| 2015/0064177 | A1 | 3/2015 | Bendig et al. |
| 2015/0093399 | A1 | 4/2015 | Jefferies |
| 2015/0197560 | A1 | 7/2015 | Fong et al. |
| 2015/0238602 | A1 | 8/2015 | Cadavid et al. |
| 2016/0129112 | A1 | 5/2016 | Neelon |
| 2016/0137737 | A1 | 5/2016 | Nishimura et al. |
| 2016/0209426 | A1 | 7/2016 | Diehl et al. |
| 2016/0340435 | A1 | 11/2016 | Chang et al. |
| 2016/0340443 | A1 | 11/2016 | Rossi et al. |
| 2016/0375133 | A1 | 12/2016 | Bhambhani et al. |
| 2017/0002077 | A1 | 1/2017 | Tam et al. |
| 2017/0020867 | A1 | 1/2017 | Moussy et al. |
| 2017/0102393 | A1 | 4/2017 | Gelzleichter et al. |
| 2017/0210807 | A1 | 7/2017 | Fong et al. |
| 2017/0258869 | A1 | 9/2017 | Li |
| 2017/0275365 | A1 | 9/2017 | Hsu et al. |
| 2017/0315133 | A1 | 11/2017 | Alexander et al. |
| 2017/0327584 | A1 | 11/2017 | Lasch |
| 2017/0360926 | A1 | 12/2017 | Rosario et al. |
| 2018/0051086 | A1 | 2/2018 | Abhyanker |
| 2018/0086833 | A1 | 3/2018 | Hassanali et al. |
| 2018/0142017 | A1 | 5/2018 | Hamrah et al. |
| 2018/0148514 | A1 | 5/2018 | Williams |
| 2018/0207279 | A1 | 7/2018 | Fox et al. |
| 2018/0289811 | A1 | 10/2018 | Fox et al. |
| 2018/0291104 | A1 | 10/2018 | Fong et al. |
| 2018/0327497 | A1 | 11/2018 | Diluzio et al. |
| 2018/0346578 | A1 | 12/2018 | Diluzio et al. |
| 2019/0010242 | A1 | 1/2019 | Eckelman et al. |
| 2019/0038744 | A1 | 2/2019 | Cadavid et al. |
| 2019/0040140 | A1 | 2/2019 | Brake et al. |
| 2019/0076532 | A1 | 3/2019 | Diluzio et al. |
| 2019/0077868 | A1 | 3/2019 | Sachs et al. |
| 2019/0192683 | A1 | 6/2019 | Jefferies |
| 2019/0231878 | A1 | 8/2019 | Brown et al. |
| 2019/0310266 | A1 | 10/2019 | Gelzleichter et al. |
| 2019/0330318 | A1 | 10/2019 | Bennett et al. |
| 2019/0330366 | A1 | 10/2019 | Eckelman et al. |
| 2019/0345240 | A1 | 11/2019 | Srinivasan et al. |
| 2020/0002422 | A1 | 1/2020 | Sachs et al. |
| 2020/0002423 | A1 | 1/2020 | Brettman et al. |
| 2020/0018751 | A1 | 1/2020 | Singh et al. |
| 2020/0025775 | A1 | 1/2020 | Diehl et al. |
| 2020/0031937 | A1 | 1/2020 | Lasch |
| 2020/0048354 | A1 | 2/2020 | Fong et al. |
| 2020/0087401 | A1 | 3/2020 | Rosario et al. |
| 2020/0148773 | A1 | 5/2020 | Taylor et al. |
| 2020/0155673 | A1 | 5/2020 | Rosario et al. |
| 2020/0165677 | A1 | 5/2020 | Stappenbeck et al. |
| 2020/0179486 | A1 | 6/2020 | Rosario et al. |
| 2020/0206353 | A1 | 7/2020 | Fox et al. |
| 2020/0241006 | A1 | 7/2020 | Naik et al. |
| 2020/0253506 | A1 | 8/2020 | Jones et al. |
| 2020/0265940 | A1 | 8/2020 | Dulai |
| 2020/0276303 | A1 | 9/2020 | Cadavid et al. |
| 2020/0283533 | A1 | 9/2020 | Hosen et al. |
| 2020/0323772 | A1 | 10/2020 | Jones et al. |
| 2020/0376092 | A1 | 12/2020 | Vitalis et al. |
| 2020/0392231 | A1 | 12/2020 | Anania et al. |
| 2020/0392232 | A1 | 12/2020 | Hassanali et al. |
| 2021/0024636 | A1 | 1/2021 | Mansour-Awad |
| 2021/0052733 | A1 | 2/2021 | Diluzio et al. |
| 2021/0147555 | A1 | 5/2021 | Jayaraman et al. |
| 2021/0238288 | A1 | 8/2021 | Anand et al. |
| 2021/0252141 | A1 | 8/2021 | Lissoos et al. |
| 2021/0253714 | A1 | 8/2021 | Jayaraman et al. |
| 2021/0260185 | A1 | 8/2021 | Cadavid et al. |
| 2021/0262032 | A1 | 8/2021 | Chowers et al. |
| 2021/0278416 | A1 | 9/2021 | Ananthakrishnan et al. |

(56) References Cited

U.S. PATENT DOCUMENTS

| | | |
|---|---|---|
| 2021/0290604 A1 | 9/2021 | Williams |
| 2021/0301002 A1 | 9/2021 | Bennett et al. |
| 2021/0322410 A1 | 10/2021 | Campbell et al. |
| 2021/0338836 A1 | 11/2021 | Yu et al. |
| 2021/0340261 A1 | 11/2021 | Diluzio et al. |
| 2021/0340584 A1 | 11/2021 | Tescione et al. |
| 2021/0388092 A1 | 12/2021 | Abhyankar |
| 2021/0396753 A1 | 12/2021 | Rubin et al. |
| 2021/0401982 A1 | 12/2021 | Jayaraman et al. |
| 2022/0010019 A1 | 1/2022 | Swirski et al. |
| 2022/0041735 A1 | 2/2022 | Hosen et al. |
| 2022/0048992 A1 | 2/2022 | Gabathuler et al. |
| 2022/0062372 A1 | 3/2022 | Srinivasan et al. |
| 2022/0098329 A1 | 3/2022 | Santich et al. |
| 2022/0162297 A1 | 5/2022 | Basi |
| 2022/0170028 A1 | 6/2022 | Li et al. |
| 2022/0186314 A1 | 6/2022 | Hackney et al. |
| 2022/0193235 A1 | 6/2022 | Herzlinger |
| 2022/0206012 A1 | 6/2022 | Chackerian |
| 2022/0220556 A1 | 7/2022 | Khatri et al. |
| 2022/0259291 A1 | 8/2022 | Oppenheim et al. |
| 2022/0267448 A1 | 8/2022 | Gowtham et al. |
| 2022/0267449 A1 | 8/2022 | Ameli et al. |
| 2022/0289855 A1 | 9/2022 | Ginsberg et al. |
| 2022/0290241 A1 | 9/2022 | McGovern et al. |
| 2022/0298232 A1 | 9/2022 | Srinivasan et al. |
| 2022/0306735 A1 | 9/2022 | Dekosky et al. |
| 2022/0349903 A1 | 11/2022 | Gelzleichter et al. |
| 2022/0357343 A1 | 11/2022 | Diehl et al. |
| 2022/0370617 A1 | 11/2022 | Diluzio et al. |
| 2022/0378739 A1 | 12/2022 | Rezvani et al. |
| 2022/0403033 A1 | 12/2022 | Anand et al. |
| 2022/0403034 A1 | 12/2022 | Hassanali et al. |
| 2023/0033021 A1 | 2/2023 | Jones et al. |
| 2023/0043949 A1 | 2/2023 | Rosario et al. |
| 2023/0048046 A1 | 2/2023 | Li et al. |
| 2023/0093155 A1 | 3/2023 | Li et al. |
| 2023/0096620 A1 | 3/2023 | Mora et al. |
| 2023/0142437 A1 | 5/2023 | Ling et al. |
| 2023/0287075 A1 | 9/2023 | Mumm |
| 2023/0295336 A1 | 9/2023 | Eckelman et al. |
| 2023/0310712 A1 | 10/2023 | Ling et al. |
| 2023/0312727 A1 | 10/2023 | Diluzio et al. |
| 2023/0313305 A1 | 10/2023 | Stappenbeck et al. |
| 2023/0340131 A1 | 10/2023 | Jayaraman et al. |
| 2023/0391887 A1 | 12/2023 | Williams |
| 2023/0399415 A1 | 12/2023 | Prever et al. |
| 2024/0084016 A1 | 3/2024 | Jayaraman et al. |
| 2024/0100158 A1 | 3/2024 | Jayaraman et al. |
| 2024/0101679 A1 | 3/2024 | Jayaraman et al. |
| 2024/0103008 A1 | 3/2024 | Baribaud et al. |
| 2024/0173402 A1 | 5/2024 | Rosario et al. |
| 2024/0182581 A1 | 6/2024 | Rosario et al. |
| 2024/0199729 A1 | 6/2024 | Johnson et al. |
| 2024/0239900 A1 | 7/2024 | Jayaraman et al. |
| 2024/0242807 A1 | 7/2024 | Minar et al. |
| 2024/0247067 A1 | 7/2024 | Brake et al. |
| 2024/0254237 A1 | 8/2024 | Jaremicz et al. |
| 2024/0279271 A1 | 8/2024 | Kumar et al. |
| 2024/0316105 A1 | 9/2024 | Sun et al. |
| 2024/0355416 A1 | 10/2024 | Ghiassian et al. |
| 2024/0360222 A1 | 10/2024 | Hosen et al. |
| 2024/0376209 A1 | 11/2024 | Kumar et al. |
| 2024/0376210 A1 | 11/2024 | Lasch |
| 2024/0376211 A1 | 11/2024 | Pudipeddi et al. |
| 2024/0384349 A1 | 11/2024 | Poirier et al. |
| 2024/0400610 A1 | 12/2024 | Kumar et al. |
| 2024/0417433 A1 | 12/2024 | Wang et al. |
| 2025/0000981 A1 | 1/2025 | Diluzio et al. |
| 2025/0034263 A1 | 1/2025 | Diluzio et al. |
| 2025/0041424 A1 | 2/2025 | Diluzio et al. |
| 2025/0042998 A1 | 2/2025 | Zhang et al. |
| 2025/0059280 A1 | 2/2025 | Pires dos Santos et al. |
| 2025/0092141 A1 | 3/2025 | Jaremicz et al. |
| 2025/0122289 A1 | 4/2025 | Sachs et al. |
| 2025/0136705 A1 | 5/2025 | Gawlitzek et al. |
| 2025/0146075 A1 | 5/2025 | Stappenbeck et al. |

FOREIGN PATENT DOCUMENTS

| | | | |
|---|---|---|---|
| EP | 1133315 B1 | 2/2006 | |
| EP | 1214091 B1 | 10/2006 | |
| EP | 0808367 B1 | 7/2007 | |
| EP | 1113810 B1 | 12/2008 | |
| EP | 1078006 B1 | 3/2009 | |
| EP | 1699826 B1 | 3/2009 | |
| EP | 1835922 B1 | 5/2009 | |
| EP | 1123086 B1 | 3/2010 | |
| EP | 1485127 B1 | 6/2011 | |
| EP | 1784426 B1 | 11/2011 | |
| EP | 2458990 B1 | 6/2012 | |
| EP | 1278543 B1 | 9/2012 | |
| EP | 1896504 B1 | 11/2012 | |
| EP | 2140881 B1 | 4/2013 | |
| EP | 2279004 B1 | 1/2015 | |
| EP | 0918797 B2 | 9/2015 | |
| EP | 2021025 B1 | 8/2016 | |
| EP | 2298348 B1 | 10/2016 | |
| EP | 2109480 B1 | 6/2017 | |
| EP | 2704742 A1 | 7/2017 | |
| EP | 2704798 B1 | 7/2017 | |
| EP | 2739649 B1 | 9/2017 | |
| EP | 2632492 B1 | 10/2017 | |
| EP | 2854845 B1 | 3/2018 | |
| EP | 3224619 B1 | 1/2019 | |
| EP | 3131559 B1 | 2/2019 | |
| EP | 2903691 B1 | 5/2019 | |
| EP | 3268742 B1 | 5/2019 | |
| EP | 2408816 B1 | 9/2019 | |
| EP | 2782599 B1 | 10/2019 | |
| EP | 3254697 B1 | 11/2019 | |
| EP | 3321281 B1 | 11/2019 | |
| EP | 3326645 B1 | 3/2020 | |
| EP | 3167902 B1 | 7/2020 | |
| EP | 2970372 B1 | 9/2020 | |
| EP | 1587540 B1 | 9/2021 | |
| EP | 3530673 B1 | 3/2022 | |
| EP | 3411120 B1 | 5/2023 | |
| EP | 3554539 B9 | 6/2023 | |
| EP | 3615001 B1 | 7/2023 | |
| EP | 3204424 B1 | 11/2023 | |
| EP | 3237004 B1 | 5/2024 | |
| EP | 4456917 A1 | 11/2024 | |
| EP | 2464725 B2 | 1/2025 | |
| EP | 4504748 A1 | 2/2025 | |
| EP | 3329965 B1 | 3/2025 | |
| WO | WO 1990007321 A2 | 7/1990 | |
| WO | WO 2000030681 A1 | 6/2000 | |
| WO | WO 2001080833 A1 | 11/2001 | |
| WO | WO 2002077610 A2 | 10/2002 | |
| WO | WO 2005046731 A1 | 5/2005 | |
| WO | WO 2007007151 A2 | 1/2007 | |
| WO | WO 2007007152 A2 | 1/2007 | |
| WO | WO 2007007159 A2 | 1/2007 | |
| WO | WO 2007007160 A2 | 1/2007 | |
| WO | WO 2007061679 A1 | 5/2007 | |
| WO | WO 2013142857 | 9/2013 | |
| WO | WO 2014049044 A1 | 4/2014 | |
| WO | WO 2014182532 A1 | 11/2014 | |
| WO | WO 2014193625 A1 | 12/2014 | |
| WO | WO 2015174978 A1 | 11/2015 | |
| WO | WO 2016144720 A1 | 9/2016 | |
| WO | WO 2017019673 A2 | 2/2017 | |
| WO | WO 2017087735 A1 | 5/2017 | |
| WO | WO 2017158393 A1 | 9/2017 | |
| WO | WO 2017165742 A1 | 9/2017 | |
| WO | WO 2017218434 A1 | 12/2017 | |
| WO | WO 2018104893 | 6/2018 | |
| WO | WO 2019180163 | 9/2019 | |
| WO | WO 2019196522 A1 | 10/2019 | |
| WO | WO 2020260315 A1 | 12/2020 | |
| WO | WO 2021003553 A1 | 1/2021 | |
| WO | WO 2021060425 A1 | 4/2021 | |

(56) References Cited

FOREIGN PATENT DOCUMENTS

| WO | WO 2021070203 A1 | 4/2021 |
| WO | WO 2021188814 A1 | 9/2021 |
| WO | WO 2021188827 A1 | 9/2021 |
| WO | WO 2022026699 A1 | 2/2022 |
| WO | WO 2022036422 A1 | 2/2022 |
| WO | WO 2022123603 A1 | 6/2022 |
| WO | WO 2022157806 A1 | 7/2022 |
| WO | WO 2022192225 A1 | 9/2022 |
| WO | WO 2022234594 A1 | 11/2022 |
| WO | WO 2022253994 A1 | 12/2022 |
| WO | WO 2022272033 A2 | 12/2022 |
| WO | WO 2023288203 A2 | 1/2023 |
| WO | WO 2023007516 A1 | 2/2023 |
| WO | WO 2023012828 A1 | 2/2023 |
| WO | WO 2023021532 A1 | 2/2023 |
| WO | WO 2023044402 A1 | 3/2023 |
| WO | WO 2023058051 A1 | 4/2023 |
| WO | WO 2023064278 A2 | 4/2023 |
| WO | WO 2023064945 A2 | 4/2023 |
| WO | WO 2023073469 A1 | 5/2023 |
| WO | WO 2023081809 A1 | 5/2023 |
| WO | WO 2023086910 A1 | 5/2023 |
| WO | WO 2023097219 A2 | 6/2023 |
| WO | WO 2023116099 A1 | 6/2023 |
| WO | WO 2023126411 A1 | 7/2023 |
| WO | WO 2023166179 A1 | 9/2023 |
| WO | 2023194837 A1 | 10/2023 |
| WO | WO 2023150731 A8 | 10/2023 |
| WO | WO 2023196866 A1 | 10/2023 |
| WO | WO 2023215882 A1 | 11/2023 |
| WO | WO 2023217072 A1 | 11/2023 |
| WO | WO 2023248207 A1 | 12/2023 |
| WO | WO 2024009205 A1 | 1/2024 |
| WO | WO 2024081269 A1 | 4/2024 |
| WO | WO 2024112618 A2 | 5/2024 |
| WO | WO 2024123793 A1 | 6/2024 |
| WO | WO 2024129960 A2 | 6/2024 |
| WO | WO 2024151852 A2 | 7/2024 |
| WO | WO 2024182425 A1 | 9/2024 |
| WO | WO 2024188443 A1 | 9/2024 |
| WO | WO 2024205498 A1 | 10/2024 |
| WO | WO 2024206308 A2 | 10/2024 |
| WO | WO 2024222859 A1 | 10/2024 |
| WO | WO 2024229094 A1 | 11/2024 |
| WO | 2024252368 A2 | 12/2024 |
| WO | WO 2024249568 A1 | 12/2024 |
| WO | 2025038708 A1 | 2/2025 |
| WO | 2025038861 A1 | 2/2025 |
| WO | 2025041000 A1 | 2/2025 |
| WO | 2025120580 A1 | 6/2025 |
| WO | 2025133872 A1 | 6/2025 |

OTHER PUBLICATIONS

Ayalew et al., "C-Terminal Lysine Processing of IgG in Human Suction Blister Fluid: Implications for Subcutaneous Administration", Molecular Pharmaceutics, vol. 19, pp. 4043-4054, 2022.

Boden et al., "Identification of Candidate Biomarkers Associated with Response to Vedolizumab in Inflammatory Bowel Disease", Digestive Diseases and Sciences, vol. 63, pp. 2419-2429, 2018.

Boden et al., "Vedolizumab Efficacy Is Associated With Decreased Intracolonic Dendritic Cells, Not Memory T Cells", Inflammatory Bowel Diseases, vol. 30, Issue 5, pp. 704-717, May 2024.

Bokemeyer et al., "Real-World Effectiveness of Vedolizumab vs Anti-TNF in Biologic-naïve Crohn's Disease Patients: A 2-year Propensity-score-adjusted Analysis from the VEDO $_{IBD}$-Study", Inflammatory Bowel Diseases, vol. 30, No. 5, pp. 746-756, May 2024.

Bressler et al., "Vedolizumab and Anti-Tumour Necrosis Factor α Real-World Outcomes in Biologic-Naïve Inflammatory Bowel Disease Patients: Results from the EVOLVE Study", Journal of Crohn's and Colitis, vol. 15, No. 10, pp. 1694-1706, Oct. 2021.

Buer et al., "Combining Anti-TNF-α and Vedolizumab in the Treatment of Inflammatory Bowel Disease: A Case Series", Inflamm Bowel Dis., vol. 24, No. 5, pp. 997-1004, May 2018.

Casanova et al., "Persistence, Effectiveness and Safety of Ustekinumab and Vedolizumab Therapy for Complex Perianal Fistula in Crohn's Disease: The HEAL Study from GETECCU", Digestive and Liver Disease, DOI:10.1016/j.dld.2024.05.009, Jun. 2024.

Colombel et al., "Vedolizumab, Adalimumab, and Methotrexate Combination Therapy in Crohn's Disease (EXPLORER)", Clinical Gastroenterology and Hepatology, vol. 22, No. 7, pp. 1487-1496, Jul. 2024.

D'Haens et al., Exposure-Efficacy Relationship of Vedolizumab Subcutaneous and Intravenous Formulations in Crohn's Disease and Ulcerative Colitis, Expert Review of Clinical Pharmacology, vol. 17, No. 4, pp. 403-412, Apr. 2024.

Dosing, "A Randomized Trial of Vedolizumab Dose Optimization in Patients With Moderate to Severe Ulcerative Colitis Who Have Early Nonresponse and High Drug Clearance: The ENTERPRET Trial", Gastroenterol. Hepatol., vol. 18, pp. 7-8, Jul. 2022.

Dreesen et al., "Evidence to Support Monitoring of Vedolizumab Trough Concentrations in Patients With Inflammatory Bowel Diseases", Clinical Gastroenterology and Hepatology, vol. 16, No. 12, pp. 1937-1946, 2018.

Engel et al., "Vedolizumab in IBD-Lessons From Real-World Experience; A Systematic Review and Pooled Analysis", Journal of Crohn's and Colitis, vol. 12, No. 2, pp. 245-257, Jan. 24, 2018.

Feagan et al., "Vedolizumab as Induction and Maintenance Therapy for Ulcerative Colitis", The New England Journal of Medicine, vol. 369, No. 8, pp. 699-710, Aug. 22, 2013.

Gabriels et al., "Using Fluorescently Labeled Vedolizumab to Visualize Local Drug Distribution During Colonoscopy and Identify Mucosal Target Cells in Patients with Inflammatory Bowel Disease".

Gonzalez et al. "Crohn's Patient Serum Proteomics Reveals Response Signature for Infliximab but not Vedolizumab". Inflamm Bowel Dis. Feb. 17, 2024:izae016. doi: 10.1093/ibd/izae016. Epub ahead of print. PMID: 38367209.

Hanzel et al., "Pharmacokinetic-Pharmacodynamic Model of Vedolizumab for Targeting Endoscopic Remission in Patients With Crohn Disease: Posthoc Analysis of the LOVE-CD Study", Inflammatory Bowel Diseases, vol. 28, pp. 689-699, 2022.

Haraya et al., "Translational Approach for Predicting Human Pharmacokinetics of Engineered Therapeutic Monoclonal Antibodies with Increased FcRn-Binding Mutations", BioDrugs, vol. 37, pp. 99-108, 2023.

Honap et al., "An Update on the Safety of Long-Term Vedolizumab Use in Inflammatory Bowel Disease", Expert Opinion on Drug Safety, vol. 22, No. 9, pp. 767-776, 2023.

Hu et al., "Evaluation of Heavy Chain C-Terminal Deletions on Productivity and Product Quality of Monoclonal Antibodies in Chinese Hamster Ovary (CHO) Cells", Biotech Progress, vol. 33, No. 3, pp. 786-794, Mar. 24, 2017.

Hu et al., "Combination Therapy Does Not Improve Rate of Clinical or Endoscopic Remission in Patients with Inflammatory Bowel Diseases Treated with Vedolizumab or Ustekinumab", Clinical Gastroenterology and Hepatology, vol. 19, pp. 1366-1376, 2021.

Hui et al., "Vedolizumab for Induction and Maintenance of Remission in Crohn's Disease", Cochrane Database of Systematic Reviews, Issue 7, Art. No. CD013611, DOI: 10.1002/14651858.CD013611.pub2, pp. 1-66, 2023.

Jiang et al., "Evaluation of Heavy-Chain C-Terminal Deletion on Product Quality and Pharmacokinetics of Monoclonal Antibodies", Journal of Pharmaceutical Sciences, vol. 105, No. 7, pp. 2066-2072, Jul. 1, 2016.

Laursen et al., "Pain Perception After Subcutaneous Injections of Media Containing Different Buffers", Basic and Clinical Pharmacology and Toxicology, vol. 98, pp. 218-221 (Year: 2006).

Liu et al., "Ustekinumab and Vedolizumab Dual Biologic Therapy in the Treatment of Crohn's Disease", Case Reports in Medicine, vol. 2017, Article ID 5264216, 2 pages, Nov. 2017.

Loftus et al., "Long-Term Safety of Vedolizumab for Inflammatory Bowel Disease", Alimentary Pharmacology & Therapeutics, vol. 52, pp. 1353-1365, 2020.

(56)         References Cited

OTHER PUBLICATIONS

Mao et al., "Safety of Dual Biological Therapy in Crohn's Disease: A Case Series of Vedolizumab in Combination with Other Biologics", BMJ Open Gastro, vol. 5, No. 1, e000243. doi:10.1136/bmjgast-2018-000243.

Nowak et al., "A Phase 1 Randomized Dose-Escalation Study of a Human Monoclonal Antibody to IL-6 in CKD", Kidney360, vol. 2, pp. 224-235, Feb. 2021.

Orito et al., "A Phase I Study to Evaluate Safety, Pharmacokinetics, and Pharmacodynamics of Respiratory Syncytial Virus Neutralizing Monoclonal Antibody MK-1654 in Healthy Japanese Adults" Clinical and Translational Science, vol. 15, No. 7, pp. 1753-1763, Jul. 2022.

Osterman et al., "Vedolizumab Exposure Levels and Clinical Outcomes in Ulcerative Colitis: Determining the Potential for Dose Optimisation", Aliment Pharmacol Ther., vol. 49, pp. 408-418, 2019.

Parikh et al., "Vedolizumab for the Treatment of Active Ulcerative Colitis: A Randomized Controlled Phase 2 Dose-Ranging Study", Inflamm Bowel Dis., vol. 18, No. 8, pp. 1470-1479, Aug. 2012.

Parrot et al., "Systematic Review with Meta-Analysis: the Effectiveness of Either Ustekinumab or Vedolizumab in Patients with Crohn's Disease Refractory to Anti-Tumour Necrosis Factor", Aliment Pharmacol Therap., vol. 55, pp. 380-388, 2022.

Peyrin-Biroulet et al., "Loss of Response to Vedolizumab and Ability of Dose Intensification to Restore Response in Patients with Crohn's Disease or Ulcerative Colitis: A Systematic Review and Meta-Analysis", Clinical Gastroenterology and Hepatology, vol. 17, No. 5, pp. 838-846, Apr. 2019.

Poole et al., "Vedolizumab: First Global Approval", Drugs, vol. 74, pp. 1293-1303, 2014.

Ramdani et al., "Monoclonal Antibody Engineering and Design to Modulate FcRn Activities: A Comprehensive Review", International Journal of Molecular Sciences, vol. 23, No., 17, pp. 9604 (1-12), Aug. 2022.

Ribaldone et al., Dual biological therapy with Anti-TNF, Vedolizumab or Ustekinumab in Inflammatory Bowel Disease: A Systematic Review with Pool Analysis, Scandinavian Journal of Gastroenterology, vol. 54, No. 4, pp. 407-413, 2019.

Rosario et al., "Population Pharmacokinetics—Pharmacodynamics of Vedolizumab in Patients with Ulcerative Colitis and Crohn's Disease", Alimentary Pharmacology & Therapeutics, vol. 42, Issue 2, pp. 188-202, Jul. 2015.

Rosario et al., "Vedolizumab Pharmacokinetics, Pharmacodynamics, Safety, and Tolerability Following Administration of a Single, Ascending, Intravenous Dose to Healthy Volunteers", Clin. Drug Investig., vol. 36, pp. 913-923, 2016.

Sandborn et al., "Vedolizumab as Induction and Maintenance Therapy for Crohn's Disease", The New England Journal of Medicine, vol. 369, No. 8, pp. 711-721, Aug. 22, 2013.

Sandborn et al., "Efficacy and safety of vedolizumab subcutaneous formulation in a randomized trial of patients with ulcerative colitis", Gastroenterology, vol. 158, No. 3, pp. 562-572, Feb. 1, 2020.

Sands et al., "Effects of Vedolizumab Induction Therapy for Patients With Crohn's Disease in Whom Tumor Necrosis Factor Antagonist Treatment Failed", Gastroenterology, vol. 147, pp. 618-627, 2014.

Sands et al., "Vedolizumab versus Adalimumab for Moderate-to-Severe Ulcerative Colitis", N.E. Journal of Medicine, vol. 381, No. 13, pp. 1215-1226, 2019.

Schmidt et al., "Predictors and Management of Loss of Response to Vedolizumab in Inflammatory Bowel Disease", Inflamm Bowel Dis., vol. 24, No. 11, pp. 2461-2467, Nov. 2018.

Sengupta et al., Higher Vedolizumab Serum Levels do not Increase the Risk of Adverse Events in Patients with Inflammatory Bowel Disease, Scand. Journal of Gastroenterology, vol. 55, No. 7, pp. 800-805, 2020.

Singh et al., "A Phase 1 Study of the Long-Acting Anti-IL-5 Monoclonal Antibody GSK3511294 in Patients with Asthma", Br. J. Clin. Pharmacol., vol. 88, pp. 702-712, 2022.

Ungar et al., "Association of Vedolizumab Level, Anti-Drug Antibodies, and a4b7 Occupancy With Response in Patients With Inflammatory Bowel Diseases", Clinical Gastroenterology and Hepatology, vol. 16, pp. 697-705, 2018.

Ungar et al., "Dose Optimisation for Loss of Response to Vedolizumab—Pharmacokinetics and Immune Mechanisms", Journal of Crohn's and Colitis, vol. 15, No. 10, pp. 1707-1719, Oct. 2021.

Vande Casteele et al., Real-world multicentre observational study including population pharmacokinetic modelling to evaluate the exposure-response relationship of vedolizumab in inflammatory bowel disease: ERELATE Study, Alimentary Pharm & Therapeutics, vol. 56, No. 3, pp. 463-476, Aug. 2022.

Veisman et al., Association of Infliximab and Vedolizumab Trough Levels with Reported Rates of Adverse Events: A Cross-Sectional Study, Journal of Clinical Medicine, vol. 10, No. 18, pp. 4265, Sep. 2021.

Vermeire et al., "Efficacy and Safety of Subcutaneous Vedolizumab in Patients With Moderately to Severely Active Crohn's Disease: Results From the VISIBLE 2 Randomised Trial", Journal of Crohn's and Colitis, vol. 16, No. 1, pp. 27-38, Jan. 2022.

Verstockt et al., "Expression Levels of 4 Genes in Colon Tissue Might Be Used to Predict Which Patients Will Enter Endoscopic Remission After Vedolizumab Therapy for Inflammatory Bowel Diseases", Clinical Gastroenterology and Hepatology, vol. 18, pp. 1142-1151, 2020.

Wyant et al., "Development and Validation of Receptor Occupancy Pharmacodynamic Assays Used in the Clinical Development of the Monoclonal Antibody Vedolizumab", Cytometry Part B (Clinical Cytometry), vol. 90B, pp. 168-176, 2016.

Wyant et al., "Vedolizumab Affects Antibody Responses to Immunization Selectively in the Gastrointestinal Tract: Randomised Controlled Trial Results", Gut, vol. 64, No. 1, pp. 77-83, 2015.

Xu et al., "PCSK9 Inhibitor Recaticimab for Hypercholesterolemia on Stable Statin Dose: a Randomized, Double-Blind, Placebo-Controlled Phase 1b/2 Study", BMC Medicine, vol. 20, No. 13, pp. 1-13, 2022.

Yarur et al., "Vedolizumab Concentrations Are Associated with Long-Term Endoscopic Remission in Patients with Inflammatory Bowel Diseases", Digestive Diseases and Sciences, vol. 64, pp. 1651-1659, 2019.

Zeissig et al., "Vedolizumab is Associated with Changes in Innate Rather than Adaptive Immunity in Patients with Inflammatory Bowel Disease", Gut, vol. 68, No. 1, pp. 25-39, Jan. 2019.

Zhu et al., "A Novel Monoclonal Antibody Drug Candidate SPY001 Targeting Integrin $\alpha4\beta7$ for the Treatment of IBD Demonstrates Prolonged Half-Life in Non-Human Primates", Abstract citation ID: jjad212.0895 p. 765.

Zhu et al., "Development and Characterization of a Novel Extended Half-Life Monoclonal Antibody Drug Candidate Targeting Integrin $\alpha4\beta7$ for the Treatment of IBD", Abstract citation ID: jjad212.0717 p. 587.

International Search Report and Written Opinion in PCT International Application No. PCT/US2024/024224 mailed Nov. 26, 2024. (13 pages).

* cited by examiner

α4β7 INTEGRIN BINDING PROTEINS AND METHODS OF USE

CROSS-REFERENCE TO RELATED APPLICATIONS

This application is a continuation of International Application No. PCT/US2024/042242, filed Aug. 14, 2024, which claims the benefit of and priority to U.S. Provisional Application No. 63/519,483, filed on Aug. 14, 2023, the entire content of each of which is incorporated herein by reference.

SEQUENCE LISTING

This application contains a Sequence Listing which has been submitted electronically in XML format and is hereby incorporated by reference in its entirety. The XML copy, created on Mar. 31, 2025, is titled 220703-010302_US-_SL.xml and is 1,927,278 bytes in size.

BACKGROUND

Integrins are cell-adhesion transmembrane receptors that function as extracellular matrix (ECM)-cytoskeletal linkers and transducers of biochemical and mechanical signals between cells and their environment. Due to their exposure on the cell surface and sensitivity to molecular inhibition, integrins such as α4β7 integrin have been investigated as pharmacological targets for treating various diseases including cancer and inflammatory diseases (e.g., inflammatory bowel disease). However, current integrin therapies have been associated with serious side effects given the role of integrins in important biological processes and/or require multiple and frequent doses to maintain therapeutic efficacy. As such, improved α4β7 integrin therapies are needed.

SUMMARY

Described herein, in certain embodiments, are α4β7 binding proteins comprising: a) a heavy chain variable region (VH) comprising (i) a CDR1 having an amino acid sequence according to SEQ ID NO: 3, (ii) a CDR2 having an amino acid sequence according to SEQ ID NO: 109, and (iii) a CDR3 having an amino acid sequence according to SEQ ID NO: 215; and a light chain variable region (VL) comprising (i) a CDR1 having an amino acid sequence according to SEQ ID NO: 321, (ii) a CDR2 having an amino acid sequence according to SEQ ID NO: 427, and (iii) a CDR3 having an amino acid sequence according to SEQ ID NO: 533; b) a heavy chain variable region (VH) comprising (i) a CDR1 having an amino acid sequence according to SEQ ID NO: 4, (ii) a CDR2 having an amino acid sequence according to SEQ ID NO: 110, and (iii) a CDR3 having an amino acid sequence according to SEQ ID NO: 216; and a light chain variable region (VL) comprising (i) a CDR1 having an amino acid sequence according to SEQ ID NO: 322, (ii) a CDR2 having an amino acid sequence according to SEQ ID NO: 428, and (iii) a CDR3 having an amino acid sequence according to SEQ ID NO: 534; c) a heavy chain variable region (VH) comprising (i) a CDR1 having an amino acid sequence according to SEQ ID NO: 5, (ii) a CDR2 having an amino acid sequence according to SEQ ID NO: 111, and (iii) a CDR3 having an amino acid sequence according to SEQ ID NO: 217; and a light chain variable region (VL) comprising (i) a CDR1 having an amino acid sequence according to SEQ ID NO: 323, (ii) a CDR2 having an amino acid sequence according to SEQ ID NO: 429, and (iii) a CDR3 having an amino acid sequence according to SEQ ID NO: 535; d) a heavy chain variable region (VH) comprising (i) a CDR1 having an amino acid sequence according to SEQ ID NO: 6, (ii) a CDR2 having an amino acid sequence according to SEQ ID NO: 112, and (iii) a CDR3 having an amino acid sequence according to SEQ ID NO: 218; and a light chain variable region (VL) comprising (i) a CDR1 having an amino acid sequence according to SEQ ID NO: 324, (ii) a CDR2 having an amino acid sequence according to SEQ ID NO: 430, and (iii) a CDR3 having an amino acid sequence according to SEQ ID NO: 536; e) a heavy chain variable region (VH) comprising (i) a CDR1 having an amino acid sequence according to SEQ ID NO: 81, (ii) a CDR2 having an amino acid sequence according to SEQ ID NO: 187, and (iii) a CDR3 having an amino acid sequence according to SEQ ID NO: 293; and a light chain variable region (VL) comprising (i) a CDR1 having an amino acid sequence according to SEQ ID NO: 399, (ii) a CDR2 having an amino acid sequence according to SEQ ID NO: 505, and (iii) a CDR3 having an amino acid sequence according to SEQ ID NO: 611; f) a heavy chain variable region (VH) comprising (i) a CDR1 having an amino acid sequence according to SEQ ID NO: 82, (ii) a CDR2 having an amino acid sequence according to SEQ ID NO: 188, and (iii) a CDR3 having an amino acid sequence according to SEQ ID NO: 294; and a light chain variable region (VL) comprising (i) a CDR1 having an amino acid sequence according to SEQ ID NO: 400, (ii) a CDR2 having an amino acid sequence according to SEQ ID NO: 506, and (iii) a CDR3 having an amino acid sequence according to SEQ ID NO: 612; or g) a heavy chain variable region (VH) comprising (i) a CDR1 having an amino acid sequence according to SEQ ID NO: 83, (ii) a CDR2 having an amino acid sequence according to SEQ ID NO: 189, and (iii) a CDR3 having an amino acid sequence according to SEQ ID NO: 295; and a light chain variable region (VL) comprising (i) a CDR1 having an amino acid sequence according to SEQ ID NO: 401, (ii) a CDR2 having an amino acid sequence according to SEQ ID NO: 507, and (iii) a CDR3 having an amino acid sequence according to SEQ ID NO: 613.

In some embodiments, the VH comprises a sequence having at least 80% sequence identity to the amino acid sequence of any one of SEQ ID NOs: 1911-1914 and 1925-1927; and the VL comprises a sequence having at least 80% sequence identity to the amino acid sequence of any one of SEQ ID NOs: 2017-2020 and 2031-2033.

In some embodiments, the VH comprises a sequence having at least 80% sequence identity to the amino acid sequence of SEQ ID NO: 1911 and the VL comprises a sequence having at least 80% sequence identity to the amino acid sequence of SEQ ID NO: 2017.

In some embodiments, the VH comprises a sequence having at least 80% sequence identity to the amino acid sequence of SEQ ID NO: 1912 and the VL comprises a sequence having at least 80% sequence identity to the amino acid sequence of SEQ ID NO: 2018.

In some embodiments, the VH comprises a sequence having at least 80% sequence identity to the amino acid sequence of SEQ ID NO: 1913 and the VL comprises a sequence having at least 80% sequence identity to the amino acid sequence of SEQ ID NO: 2019.

In some embodiments, the VH comprises a sequence having at least 80% sequence identity to the amino acid sequence of SEQ ID NO: 1914 and the VL comprises a sequence having at least 80% sequence identity to the amino acid sequence of SEQ ID NO: 2020.

In some embodiments, the VH comprises a sequence having at least 80% sequence identity to the amino acid sequence of SEQ ID NO: 1925 and the VL comprises a sequence having at least 80% sequence identity to the amino acid sequence of SEQ ID NO: 2031.

In some embodiments, the VH comprises a sequence having at least 80% sequence identity to the amino acid sequence of SEQ ID NO: 1926 and the VL comprises a sequence having at least 80% sequence identity to the amino acid sequence of SEQ ID NO: 2032.

In some embodiments, the VH comprises a sequence having at least 80% sequence identity to the amino acid sequence of SEQ ID NO: 1927 and the VL comprises a sequence having at least 80% sequence identity to the amino acid sequence of SEQ ID NO: 2033.

Described herein, in certain embodiments, are $\alpha 4\beta 7$ binding proteins comprising: a) a heavy chain variable region (VH) comprising (i) a CDR1 having an amino acid sequence according to any one of SEQ ID NOs: 7-26, 32-58, 60-80, and 84-106; (ii) a CDR2 having an amino acid sequence according to any one of SEQ ID NOs: 113-132, 138-164, 166-186, and 190-212; and (iii) a CDR3 having an amino acid sequence according to any one of SEQ ID NOs: 219-238, 244-270, 272-292, and 296-318; and b) a light chain variable region (VL) comprising (i) a CDR1 having an amino acid sequence according to any one of SEQ ID NOs: 325-344, 350-376, 378-398, and 402-424; (ii) a CDR2 having an amino acid sequence according to any one of SEQ ID NOs: 431-450, 456-482, 484-504, and 508-530; and (iii) a CDR3 having an amino acid sequence according to any one of SEQ ID NOs: 537-556, 562-588, 590-610, and 614-636.

In some embodiments, the VH comprises (i) a CDR1 having an amino acid sequence according to SEQ ID NO: 7; (ii) a CDR2 having an amino acid sequence according to SEQ ID NO: 113; and (iii) a CDR3 having an amino acid sequence according to SEQ ID NO: 219; and the VL comprises (i) a CDR1 having an amino acid sequence according to SEQ ID NO: 325; (ii) a CDR2 having an amino acid sequence according to SEQ ID NO: 431; and (iii) a CDR3 having an amino acid sequence according to SEQ ID NO: 537.

In some embodiments, the VH comprises (i) a CDR1 having an amino acid sequence according to SEQ ID NO: 8; (ii) a CDR2 having an amino acid sequence according to SEQ ID NO: 114; and (iii) a CDR3 having an amino acid sequence according to SEQ ID NO: 220; and the VL comprises (i) a CDR1 having an amino acid sequence according to SEQ ID NO: 326; (ii) a CDR2 having an amino acid sequence according to SEQ ID NO: 432; and (iii) a CDR3 having an amino acid sequence according to SEQ ID NO: 538.

In some embodiments, the VH comprises (i) a CDR1 having an amino acid sequence according to SEQ ID NO: 9; (ii) a CDR2 having an amino acid sequence according to SEQ ID NO: 115; and (iii) a CDR3 having an amino acid sequence according to SEQ ID NO: 221; and the VL comprises (i) a CDR1 having an amino acid sequence according to SEQ ID NO: 327; (ii) a CDR2 having an amino acid sequence according to SEQ ID NO: 433; and (iii) a CDR3 having an amino acid sequence according to SEQ ID NO: 539.

In some embodiments, the VH comprises (i) a CDR1 having an amino acid sequence according to SEQ ID NO: 10; (ii) a CDR2 having an amino acid sequence according to SEQ ID NO: 116; and (iii) a CDR3 having an amino acid sequence according to SEQ ID NO: 222; and the VL comprises (i) a CDR1 having an amino acid sequence according to SEQ ID NO: 328; (ii) a CDR2 having an amino acid sequence according to SEQ ID NO: 434; and (iii) a CDR3 having an amino acid sequence according to SEQ ID NO: 540.

In some embodiments, the VH comprises (i) a CDR1 having an amino acid sequence according to SEQ ID NO: 11; (ii) a CDR2 having an amino acid sequence according to SEQ ID NO: 117; and (iii) a CDR3 having an amino acid sequence according to SEQ ID NO: 223; and the VL comprises (i) a CDR1 having an amino acid sequence according to SEQ ID NO: 329; (ii) a CDR2 having an amino acid sequence according to SEQ ID NO: 435; and (iii) a CDR3 having an amino acid sequence according to SEQ ID NO: 541.

In some embodiments, the VH comprises (i) a CDR1 having an amino acid sequence according to SEQ ID NO: 12; (ii) a CDR2 having an amino acid sequence according to SEQ ID NO: 118; and (iii) a CDR3 having an amino acid sequence according to SEQ ID NO: 224; and the VL comprises (i) a CDR1 having an amino acid sequence according to SEQ ID NO: 330; (ii) a CDR2 having an amino acid sequence according to SEQ ID NO: 436; and (iii) a CDR3 having an amino acid sequence according to SEQ ID NO: 542.

In some embodiments, the VH comprises (i) a CDR1 having an amino acid sequence according to SEQ ID NO: 13; (ii) a CDR2 having an amino acid sequence according to SEQ ID NO: 119; and (iii) a CDR3 having an amino acid sequence according to SEQ ID NO: 225; and the VL comprises (i) a CDR1 having an amino acid sequence according to SEQ ID NO: 331; (ii) a CDR2 having an amino acid sequence according to SEQ ID NO: 437; and (iii) a CDR3 having an amino acid sequence according to SEQ ID NO: 543.

In some embodiments, the VH comprises (i) a CDR1 having an amino acid sequence according to SEQ ID NO: 14; (ii) a CDR2 having an amino acid sequence according to SEQ ID NO: 120; and (iii) a CDR3 having an amino acid sequence according to SEQ ID NO: 226; and the VL comprises (i) a CDR1 having an amino acid sequence according to SEQ ID NO: 332; (ii) a CDR2 having an amino acid sequence according to SEQ ID NO: 438; and (iii) a CDR3 having an amino acid sequence according to SEQ ID NO: 544.

In some embodiments, the VH comprises (i) a CDR1 having an amino acid sequence according to SEQ ID NO: 15; (ii) a CDR2 having an amino acid sequence according to SEQ ID NO: 121; and (iii) a CDR3 having an amino acid sequence according to SEQ ID NO: 227; and the VL comprises (i) a CDR1 having an amino acid sequence according to SEQ ID NO: 333; (ii) a CDR2 having an amino acid sequence according to SEQ ID NO: 439; and (iii) a CDR3 having an amino acid sequence according to SEQ ID NO: 545.

In some embodiments, the VH comprises (i) a CDR1 having an amino acid sequence according to SEQ ID NO: 16; (ii) a CDR2 having an amino acid sequence according to SEQ ID NO: 122; and (iii) a CDR3 having an amino acid sequence according to SEQ ID NO: 228; and the VL comprises (i) a CDR1 having an amino acid sequence according to SEQ ID NO: 334; (ii) a CDR2 having an amino acid sequence according to SEQ ID NO: 440; and (iii) a CDR3 having an amino acid sequence according to SEQ ID NO: 546.

In some embodiments, the VH comprises (i) a CDR1 having an amino acid sequence according to SEQ ID NO:

17; (ii) a CDR2 having an amino acid sequence according to SEQ ID NO: 123; and (iii) a CDR3 having an amino acid sequence according to SEQ ID NO: 229; and the VL comprises (i) a CDR1 having an amino acid sequence according to SEQ ID NO: 335; (ii) a CDR2 having an amino acid sequence according to SEQ ID NO: 441; and (iii) a CDR3 having an amino acid sequence according to SEQ ID NO: 547.

In some embodiments, the VH comprises (i) a CDR1 having an amino acid sequence according to SEQ ID NO: 18; (ii) a CDR2 having an amino acid sequence according to SEQ ID NO: 124; and (iii) a CDR3 having an amino acid sequence according to SEQ ID NO: 230; and the VL comprises (i) a CDR1 having an amino acid sequence according to SEQ ID NO: 336; (ii) a CDR2 having an amino acid sequence according to SEQ ID NO: 442; and (iii) a CDR3 having an amino acid sequence according to SEQ ID NO: 548.

In some embodiments, the VH comprises (i) a CDR1 having an amino acid sequence according to SEQ ID NO: 19; (ii) a CDR2 having an amino acid sequence according to SEQ ID NO: 125; and (iii) a CDR3 having an amino acid sequence according to SEQ ID NO: 231; and the VL comprises (i) a CDR1 having an amino acid sequence according to SEQ ID NO: 337; (ii) a CDR2 having an amino acid sequence according to SEQ ID NO: 443; and (iii) a CDR3 having an amino acid sequence according to SEQ ID NO: 549.

In some embodiments, the VH comprises (i) a CDR1 having an amino acid sequence according to SEQ ID NO: 20; (ii) a CDR2 having an amino acid sequence according to SEQ ID NO: 126; and (iii) a CDR3 having an amino acid sequence according to SEQ ID NO: 232; and the VL comprises (i) a CDR1 having an amino acid sequence according to SEQ ID NO: 338; (ii) a CDR2 having an amino acid sequence according to SEQ ID NO: 444; and (iii) a CDR3 having an amino acid sequence according to SEQ ID NO: 550.

In some embodiments, the VH comprises (i) a CDR1 having an amino acid sequence according to SEQ ID NO: 21; (ii) a CDR2 having an amino acid sequence according to SEQ ID NO: 127; and (iii) a CDR3 having an amino acid sequence according to SEQ ID NO: 233; and the VL comprises (i) a CDR1 having an amino acid sequence according to SEQ ID NO: 339; (ii) a CDR2 having an amino acid sequence according to SEQ ID NO: 445; and (iii) a CDR3 having an amino acid sequence according to SEQ ID NO: 551.

In some embodiments, the VH comprises (i) a CDR1 having an amino acid sequence according to SEQ ID NO: 22; (ii) a CDR2 having an amino acid sequence according to SEQ ID NO: 128; and (iii) a CDR3 having an amino acid sequence according to SEQ ID NO: 234; and the VL comprises (i) a CDR1 having an amino acid sequence according to SEQ ID NO: 340; (ii) a CDR2 having an amino acid sequence according to SEQ ID NO: 446; and (iii) a CDR3 having an amino acid sequence according to SEQ ID NO: 552.

In some embodiments, the VH comprises (i) a CDR1 having an amino acid sequence according to SEQ ID NO: 23; (ii) a CDR2 having an amino acid sequence according to SEQ ID NO: 129; and (iii) a CDR3 having an amino acid sequence according to SEQ ID NO: 235; and the VL comprises (i) a CDR1 having an amino acid sequence according to SEQ ID NO: 341; (ii) a CDR2 having an amino acid sequence according to SEQ ID NO: 447; and (iii) a CDR3 having an amino acid sequence according to SEQ ID NO: 553.

In some embodiments, the VH comprises (i) a CDR1 having an amino acid sequence according to SEQ ID NO: 24; (ii) a CDR2 having an amino acid sequence according to SEQ ID NO: 130; and (iii) a CDR3 having an amino acid sequence according to SEQ ID NO: 236; and the VL comprises (i) a CDR1 having an amino acid sequence according to SEQ ID NO: 342; (ii) a CDR2 having an amino acid sequence according to SEQ ID NO: 448; and (iii) a CDR3 having an amino acid sequence according to SEQ ID NO: 554.

In some embodiments, the VH comprises (i) a CDR1 having an amino acid sequence according to SEQ ID NO: 25; (ii) a CDR2 having an amino acid sequence according to SEQ ID NO: 131; and (iii) a CDR3 having an amino acid sequence according to SEQ ID NO: 237; and the VL comprises (i) a CDR1 having an amino acid sequence according to SEQ ID NO: 343; (ii) a CDR2 having an amino acid sequence according to SEQ ID NO: 449; and (iii) a CDR3 having an amino acid sequence according to SEQ ID NO: 555.

In some embodiments, the VH comprises (i) a CDR1 having an amino acid sequence according to SEQ ID NO: 26; (ii) a CDR2 having an amino acid sequence according to SEQ ID NO: 132; and (iii) a CDR3 having an amino acid sequence according to SEQ ID NO: 238; and the VL comprises (i) a CDR1 having an amino acid sequence according to SEQ ID NO: 344; (ii) a CDR2 having an amino acid sequence according to SEQ ID NO: 450; and (iii) a CDR3 having an amino acid sequence according to SEQ ID NO: 556.

In some embodiments, the VH comprises (i) a CDR1 having an amino acid sequence according to SEQ ID NO: 32; (ii) a CDR2 having an amino acid sequence according to SEQ ID NO: 138; and (iii) a CDR3 having an amino acid sequence according to SEQ ID NO: 244; and the VL comprises (i) a CDR1 having an amino acid sequence according to SEQ ID NO: 350; (ii) a CDR2 having an amino acid sequence according to SEQ ID NO: 456; and (iii) a CDR3 having an amino acid sequence according to SEQ ID NO: 562.

In some embodiments, the VH comprises (i) a CDR1 having an amino acid sequence according to SEQ ID NO: 33; (ii) a CDR2 having an amino acid sequence according to SEQ ID NO: 139; and (iii) a CDR3 having an amino acid sequence according to SEQ ID NO: 245; and the VL comprises (i) a CDR1 having an amino acid sequence according to SEQ ID NO: 351; (ii) a CDR2 having an amino acid sequence according to SEQ ID NO: 457; and (iii) a CDR3 having an amino acid sequence according to SEQ ID NO: 563.

In some embodiments, the VH comprises (i) a CDR1 having an amino acid sequence according to SEQ ID NO: 34; (ii) a CDR2 having an amino acid sequence according to SEQ ID NO: 140; and (iii) a CDR3 having an amino acid sequence according to SEQ ID NO: 246; and the VL comprises (i) a CDR1 having an amino acid sequence according to SEQ ID NO: 352; (ii) a CDR2 having an amino acid sequence according to SEQ ID NO: 458; and (iii) a CDR3 having an amino acid sequence according to SEQ ID NO: 564.

In some embodiments, the VH comprises (i) a CDR1 having an amino acid sequence according to SEQ ID NO: 35; (ii) a CDR2 having an amino acid sequence according to SEQ ID NO: 141; and (iii) a CDR3 having an amino acid sequence according to SEQ ID NO: 247; and the VL comprises (i) a CDR1 having an amino acid sequence according to SEQ ID NO: 353; (ii) a CDR2 having an amino acid sequence according to SEQ ID NO: 459; and (iii) a CDR3 having an amino acid sequence according to SEQ ID NO: 565.

In some embodiments, the VH comprises (i) a CDR1 having an amino acid sequence according to SEQ ID NO: 36; (ii) a CDR2 having an amino acid sequence according to SEQ ID NO: 142; and (iii) a CDR3 having an amino acid sequence according to SEQ ID NO: 248; and the VL comprises (i) a CDR1 having an amino acid sequence according to SEQ ID NO: 354; (ii) a CDR2 having an amino acid sequence according to SEQ ID NO: 460; and (iii) a CDR3 having an amino acid sequence according to SEQ ID NO: 566.

In some embodiments, the VH comprises (i) a CDR1 having an amino acid sequence according to SEQ ID NO: 37; (ii) a CDR2 having an amino acid sequence according to SEQ ID NO: 143; and (iii) a CDR3 having an amino acid sequence according to SEQ ID NO: 249; and the VL comprises (i) a CDR1 having an amino acid sequence according to SEQ ID NO: 355; (ii) a CDR2 having an amino acid sequence according to SEQ ID NO: 461; and (iii) a CDR3 having an amino acid sequence according to SEQ ID NO: 567.

In some embodiments, the VH comprises (i) a CDR1 having an amino acid sequence according to SEQ ID NO: 38; (ii) a CDR2 having an amino acid sequence according to SEQ ID NO: 144; and (iii) a CDR3 having an amino acid sequence according to SEQ ID NO: 250; and the VL comprises (i) a CDR1 having an amino acid sequence according to SEQ ID NO: 356; (ii) a CDR2 having an amino acid sequence according to SEQ ID NO: 462; and (iii) a CDR3 having an amino acid sequence according to SEQ ID NO: 568.

In some embodiments, the VH comprises (i) a CDR1 having an amino acid sequence according to SEQ ID NO: 39; (ii) a CDR2 having an amino acid sequence according to SEQ ID NO: 145; and (iii) a CDR3 having an amino acid sequence according to SEQ ID NO: 251; and the VL comprises (i) a CDR1 having an amino acid sequence according to SEQ ID NO: 357; (ii) a CDR2 having an amino acid sequence according to SEQ ID NO: 463; and (iii) a CDR3 having an amino acid sequence according to SEQ ID NO: 569.

In some embodiments, the VH comprises (i) a CDR1 having an amino acid sequence according to SEQ ID NO: 40; (ii) a CDR2 having an amino acid sequence according to SEQ ID NO: 146; and (iii) a CDR3 having an amino acid sequence according to SEQ ID NO: 252; and the VL comprises (i) a CDR1 having an amino acid sequence according to SEQ ID NO: 358; (ii) a CDR2 having an amino acid sequence according to SEQ ID NO: 464; and (iii) a CDR3 having an amino acid sequence according to SEQ ID NO: 570.

In some embodiments, the VH comprises (i) a CDR1 having an amino acid sequence according to SEQ ID NO: 41; (ii) a CDR2 having an amino acid sequence according to SEQ ID NO: 147; and (iii) a CDR3 having an amino acid sequence according to SEQ ID NO: 253; and the VL comprises (i) a CDR1 having an amino acid sequence according to SEQ ID NO: 359; (ii) a CDR2 having an amino acid sequence according to SEQ ID NO: 465; and (iii) a CDR3 having an amino acid sequence according to SEQ ID NO: 571.

In some embodiments, the VH comprises (i) a CDR1 having an amino acid sequence according to SEQ ID NO: 42; (ii) a CDR2 having an amino acid sequence according to SEQ ID NO: 148; and (iii) a CDR3 having an amino acid sequence according to SEQ ID NO: 254; and the VL comprises (i) a CDR1 having an amino acid sequence according to SEQ ID NO: 360; (ii) a CDR2 having an amino acid sequence according to SEQ ID NO: 466; and (iii) a CDR3 having an amino acid sequence according to SEQ ID NO: 572.

In some embodiments, the VH comprises (i) a CDR1 having an amino acid sequence according to SEQ ID NO: 43; (ii) a CDR2 having an amino acid sequence according to SEQ ID NO: 149; and (iii) a CDR3 having an amino acid sequence according to SEQ ID NO: 255; and the VL comprises (i) a CDR1 having an amino acid sequence according to SEQ ID NO: 361; (ii) a CDR2 having an amino acid sequence according to SEQ ID NO: 467; and (iii) a CDR3 having an amino acid sequence according to SEQ ID NO: 573.

In some embodiments, the VH comprises (i) a CDR1 having an amino acid sequence according to SEQ ID NO: 44; (ii) a CDR2 having an amino acid sequence according to SEQ ID NO: 150; and (iii) a CDR3 having an amino acid sequence according to SEQ ID NO: 256; and the VL comprises (i) a CDR1 having an amino acid sequence according to SEQ ID NO: 362; (ii) a CDR2 having an amino acid sequence according to SEQ ID NO: 468; and (iii) a CDR3 having an amino acid sequence according to SEQ ID NO: 574.

In some embodiments, the VH comprises (i) a CDR1 having an amino acid sequence according to SEQ ID NO: 45; (ii) a CDR2 having an amino acid sequence according to SEQ ID NO: 151; and (iii) a CDR3 having an amino acid sequence according to SEQ ID NO: 257; and the VL comprises (i) a CDR1 having an amino acid sequence according to SEQ ID NO: 363; (ii) a CDR2 having an amino acid sequence according to SEQ ID NO: 469; and (iii) a CDR3 having an amino acid sequence according to SEQ ID NO: 575.

In some embodiments, the VH comprises (i) a CDR1 having an amino acid sequence according to SEQ ID NO: 46; (ii) a CDR2 having an amino acid sequence according to SEQ ID NO: 152; and (iii) a CDR3 having an amino acid sequence according to SEQ ID NO: 258; and the VL comprises (i) a CDR1 having an amino acid sequence according to SEQ ID NO: 364; (ii) a CDR2 having an amino acid sequence according to SEQ ID NO: 470; and (iii) a CDR3 having an amino acid sequence according to SEQ ID NO: 576.

In some embodiments, the VH comprises (i) a CDR1 having an amino acid sequence according to SEQ ID NO: 47; (ii) a CDR2 having an amino acid sequence according to SEQ ID NO: 153; and (iii) a CDR3 having an amino acid sequence according to SEQ ID NO: 259; and the VL comprises (i) a CDR1 having an amino acid sequence according to SEQ ID NO: 365; (ii) a CDR2 having an amino acid sequence according to SEQ ID NO: 471; and (iii) a CDR3 having an amino acid sequence according to SEQ ID NO: 577.

In some embodiments, the VH comprises (i) a CDR1 having an amino acid sequence according to SEQ ID NO: 48; (ii) a CDR2 having an amino acid sequence according to SEQ ID NO: 154; and (iii) a CDR3 having an amino acid sequence according to SEQ ID NO: 260; and the VL comprises (i) a CDR1 having an amino acid sequence according to SEQ ID NO: 366; (ii) a CDR2 having an amino acid sequence according to SEQ ID NO: 472; and (iii) a CDR3 having an amino acid sequence according to SEQ ID NO: 578.

In some embodiments, the VH comprises (i) a CDR1 having an amino acid sequence according to SEQ ID NO: 49; (ii) a CDR2 having an amino acid sequence according to SEQ ID NO: 155; and (iii) a CDR3 having an amino acid sequence according to SEQ ID NO: 261; and the VL comprises (i) a CDR1 having an amino acid sequence according to SEQ ID NO: 367; (ii) a CDR2 having an amino acid sequence according to SEQ ID NO: 473; and (iii) a CDR3 having an amino acid sequence according to SEQ ID NO: 579.

In some embodiments, the VH comprises (i) a CDR1 having an amino acid sequence according to SEQ ID NO: 50; (ii) a CDR2 having an amino acid sequence according to SEQ ID NO: 156; and (iii) a CDR3 having an amino acid sequence according to SEQ ID NO: 262; and the VL comprises (i) a CDR1 having an amino acid sequence according to SEQ ID NO: 368; (ii) a CDR2 having an amino acid sequence according to SEQ ID NO: 474; and (iii) a CDR3 having an amino acid sequence according to SEQ ID NO: 580.

In some embodiments, the VH comprises (i) a CDR1 having an amino acid sequence according to SEQ ID NO: 51; (ii) a CDR2 having an amino acid sequence according to SEQ ID NO: 157; and (iii) a CDR3 having an amino acid sequence according to SEQ ID NO: 263; and the VL comprises (i) a CDR1 having an amino acid sequence according to SEQ ID NO: 369; (ii) a CDR2 having an amino acid sequence according to SEQ ID NO: 475; and (iii) a CDR3 having an amino acid sequence according to SEQ ID NO: 581.

In some embodiments, the VH comprises (i) a CDR1 having an amino acid sequence according to SEQ ID NO: 52; (ii) a CDR2 having an amino acid sequence according to SEQ ID NO: 158; and (iii) a CDR3 having an amino acid sequence according to SEQ ID NO: 264; and the VL comprises (i) a CDR1 having an amino acid sequence according to SEQ ID NO: 370; (ii) a CDR2 having an amino acid sequence according to SEQ ID NO: 476; and (iii) a CDR3 having an amino acid sequence according to SEQ ID NO: 582.

In some embodiments, the VH comprises (i) a CDR1 having an amino acid sequence according to SEQ ID NO: 53; (ii) a CDR2 having an amino acid sequence according to SEQ ID NO: 159; and (iii) a CDR3 having an amino acid sequence according to SEQ ID NO: 265; and the VL comprises (i) a CDR1 having an amino acid sequence according to SEQ ID NO: 371; (ii) a CDR2 having an amino acid sequence according to SEQ ID NO: 477; and (iii) a CDR3 having an amino acid sequence according to SEQ ID NO: 583.

In some embodiments, the VH comprises (i) a CDR1 having an amino acid sequence according to SEQ ID NO: 54; (ii) a CDR2 having an amino acid sequence according to SEQ ID NO: 160; and (iii) a CDR3 having an amino acid sequence according to SEQ ID NO: 266; and the VL comprises (i) a CDR1 having an amino acid sequence according to SEQ ID NO: 372; (ii) a CDR2 having an amino acid sequence according to SEQ ID NO: 478; and (iii) a CDR3 having an amino acid sequence according to SEQ ID NO: 584.

In some embodiments, the VH comprises (i) a CDR1 having an amino acid sequence according to SEQ ID NO: 55; (ii) a CDR2 having an amino acid sequence according to SEQ ID NO: 161; and (iii) a CDR3 having an amino acid sequence according to SEQ ID NO: 267; and the VL comprises (i) a CDR1 having an amino acid sequence according to SEQ ID NO: 373; (ii) a CDR2 having an amino acid sequence according to SEQ ID NO: 479; and (iii) a CDR3 having an amino acid sequence according to SEQ ID NO: 585.

In some embodiments, the VH comprises (i) a CDR1 having an amino acid sequence according to SEQ ID NO: 56; (ii) a CDR2 having an amino acid sequence according to SEQ ID NO: 162; and (iii) a CDR3 having an amino acid sequence according to SEQ ID NO: 268; and the VL comprises (i) a CDR1 having an amino acid sequence according to SEQ ID NO: 374; (ii) a CDR2 having an amino acid sequence according to SEQ ID NO: 480; and (iii) a CDR3 having an amino acid sequence according to SEQ ID NO: 586.

In some embodiments, the VH comprises (i) a CDR1 having an amino acid sequence according to SEQ ID NO: 57; (ii) a CDR2 having an amino acid sequence according to SEQ ID NO: 163; and (iii) a CDR3 having an amino acid sequence according to SEQ ID NO: 269; and the VL comprises (i) a CDR1 having an amino acid sequence according to SEQ ID NO: 375; (ii) a CDR2 having an amino acid sequence according to SEQ ID NO: 481; and (iii) a CDR3 having an amino acid sequence according to SEQ ID NO: 587.

In some embodiments, the VH comprises (i) a CDR1 having an amino acid sequence according to SEQ ID NO: 58; (ii) a CDR2 having an amino acid sequence according to SEQ ID NO: 164; and (iii) a CDR3 having an amino acid sequence according to SEQ ID NO: 270; and the VL comprises (i) a CDR1 having an amino acid sequence according to SEQ ID NO: 376; (ii) a CDR2 having an amino acid sequence according to SEQ ID NO: 482; and (iii) a CDR3 having an amino acid sequence according to SEQ ID NO: 588.

In some embodiments, the VH comprises (i) a CDR1 having an amino acid sequence according to SEQ ID NO: 60; (ii) a CDR2 having an amino acid sequence according to SEQ ID NO: 166; and (iii) a CDR3 having an amino acid sequence according to SEQ ID NO: 272; and the VL comprises (i) a CDR1 having an amino acid sequence according to SEQ ID NO: 378; (ii) a CDR2 having an amino acid sequence according to SEQ ID NO: 484; and (iii) a CDR3 having an amino acid sequence according to SEQ ID NO: 590.

In some embodiments, the VH comprises (i) a CDR1 having an amino acid sequence according to SEQ ID NO: 61; (ii) a CDR2 having an amino acid sequence according to SEQ ID NO: 167; and (iii) a CDR3 having an amino acid sequence according to SEQ ID NO: 273; and the VL comprises (i) a CDR1 having an amino acid sequence according to SEQ ID NO: 379; (ii) a CDR2 having an amino acid sequence according to SEQ ID NO: 485; and (iii) a CDR3 having an amino acid sequence according to SEQ ID NO: 591.

In some embodiments, the VH comprises (i) a CDR1 having an amino acid sequence according to SEQ ID NO: 62; (ii) a CDR2 having an amino acid sequence according to SEQ ID NO: 168; and (iii) a CDR3 having an amino acid sequence according to SEQ ID NO: 274; and the VL comprises (i) a CDR1 having an amino acid sequence according to SEQ ID NO: 380; (ii) a CDR2 having an amino acid sequence according to SEQ ID NO: 486; and (iii) a CDR3 having an amino acid sequence according to SEQ ID NO: 592.

In some embodiments, the VH comprises (i) a CDR1 having an amino acid sequence according to SEQ ID NO: 63; (ii) a CDR2 having an amino acid sequence according to SEQ ID NO: 169; and (iii) a CDR3 having an amino acid sequence according to SEQ ID NO: 275; and the VL comprises (i) a CDR1 having an amino acid sequence according to SEQ ID NO: 381; (ii) a CDR2 having an amino acid sequence according to SEQ ID NO: 487; and (iii) a CDR3 having an amino acid sequence according to SEQ ID NO: 593.

In some embodiments, the VH comprises (i) a CDR1 having an amino acid sequence according to SEQ ID NO: 64; (ii) a CDR2 having an amino acid sequence according to SEQ ID NO: 170; and (iii) a CDR3 having an amino acid sequence according to SEQ ID NO: 276; and the VL comprises (i) a CDR1 having an amino acid sequence according to SEQ ID NO: 382; (ii) a CDR2 having an amino acid sequence according to SEQ ID NO: 488; and (iii) a CDR3 having an amino acid sequence according to SEQ ID NO: 594.

In some embodiments, the VH comprises (i) a CDR1 having an amino acid sequence according to SEQ ID NO: 65; (ii) a CDR2 having an amino acid sequence according to SEQ ID NO: 171; and (iii) a CDR3 having an amino acid sequence according to SEQ ID NO: 277; and the VL comprises (i) a CDR1 having an amino acid sequence according to SEQ ID NO: 383; (ii) a CDR2 having an amino acid sequence according to SEQ ID NO: 489; and (iii) a CDR3 having an amino acid sequence according to SEQ ID NO: 595.

In some embodiments, the VH comprises (i) a CDR1 having an amino acid sequence according to SEQ ID NO: 66; (ii) a CDR2 having an amino acid sequence according to SEQ ID NO: 172; and (iii) a CDR3 having an amino acid sequence according to SEQ ID NO: 278; and the VL comprises (i) a CDR1 having an amino acid sequence according to SEQ ID NO: 384; (ii) a CDR2 having an amino acid sequence according to SEQ ID NO: 490; and (iii) a CDR3 having an amino acid sequence according to SEQ ID NO: 596.

In some embodiments, the VH comprises (i) a CDR1 having an amino acid sequence according to SEQ ID NO: 67; (ii) a CDR2 having an amino acid sequence according to SEQ ID NO: 173; and (iii) a CDR3 having an amino acid sequence according to SEQ ID NO: 279; and the VL comprises (i) a CDR1 having an amino acid sequence according to SEQ ID NO: 385; (ii) a CDR2 having an amino acid sequence according to SEQ ID NO: 491; and (iii) a CDR3 having an amino acid sequence according to SEQ ID NO: 597. In some embodiments, the VH comprises (i) a CDR1 having an amino acid sequence according to SEQ ID NO: 68; (ii) a CDR2 having an amino acid sequence according to SEQ ID NO: 174; and (iii) a CDR3 having an amino acid sequence according to SEQ ID NO: 280; and the VL comprises (i) a CDR1 having an amino acid sequence according to SEQ ID NO: 386; (ii) a CDR2 having an amino acid sequence according to SEQ ID NO: 492; and (iii) a CDR3 having an amino acid sequence according to SEQ ID NO: 598.

In some embodiments, the VH comprises (i) a CDR1 having an amino acid sequence according to SEQ ID NO: 69; (ii) a CDR2 having an amino acid sequence according to SEQ ID NO: 175; and (iii) a CDR3 having an amino acid sequence according to SEQ ID NO: 281; and the VL comprises (i) a CDR1 having an amino acid sequence according to SEQ ID NO: 387; (ii) a CDR2 having an amino acid sequence according to SEQ ID NO: 493; and (iii) a CDR3 having an amino acid sequence according to SEQ ID NO: 599.

In some embodiments, the VH comprises (i) a CDR1 having an amino acid sequence according to SEQ ID NO: 70; (ii) a CDR2 having an amino acid sequence according to SEQ ID NO: 176; and (iii) a CDR3 having an amino acid sequence according to SEQ ID NO: 282; and the VL comprises (i) a CDR1 having an amino acid sequence according to SEQ ID NO: 388; (ii) a CDR2 having an amino acid sequence according to SEQ ID NO: 494; and (iii) a CDR3 having an amino acid sequence according to SEQ ID NO: 600.

In some embodiments, the VH comprises (i) a CDR1 having an amino acid sequence according to SEQ ID NO: 71; (ii) a CDR2 having an amino acid sequence according to SEQ ID NO: 177; and (iii) a CDR3 having an amino acid sequence according to SEQ ID NO: 283; and the VL comprises (i) a CDR1 having an amino acid sequence according to SEQ ID NO: 389; (ii) a CDR2 having an amino acid sequence according to SEQ ID NO: 495; and (iii) a CDR3 having an amino acid sequence according to SEQ ID NO: 601.

In some embodiments, the VH comprises (i) a CDR1 having an amino acid sequence according to SEQ ID NO: 72; (ii) a CDR2 having an amino acid sequence according to SEQ ID NO: 178; and (iii) a CDR3 having an amino acid sequence according to SEQ ID NO: 284; and the VL comprises (i) a CDR1 having an amino acid sequence according to SEQ ID NO: 390; (ii) a CDR2 having an amino acid sequence according to SEQ ID NO: 496; and (iii) a CDR3 having an amino acid sequence according to SEQ ID NO: 602.

In some embodiments, the VH comprises (i) a CDR1 having an amino acid sequence according to SEQ ID NO: 73; (ii) a CDR2 having an amino acid sequence according to SEQ ID NO: 179; and (iii) a CDR3 having an amino acid sequence according to SEQ ID NO: 285; and the VL comprises (i) a CDR1 having an amino acid sequence according to SEQ ID NO: 391; (ii) a CDR2 having an amino acid sequence according to SEQ ID NO: 497; and (iii) a CDR3 having an amino acid sequence according to SEQ ID NO: 603.

In some embodiments, the VH comprises (i) a CDR1 having an amino acid sequence according to SEQ ID NO: 74; (ii) a CDR2 having an amino acid sequence according to SEQ ID NO: 180; and (iii) a CDR3 having an amino acid sequence according to SEQ ID NO: 286; and the VL comprises (i) a CDR1 having an amino acid sequence according to SEQ ID NO: 392; (ii) a CDR2 having an amino acid sequence according to SEQ ID NO: 498; and (iii) a CDR3 having an amino acid sequence according to SEQ ID NO: 604.

In some embodiments, the VH comprises (i) a CDR1 having an amino acid sequence according to SEQ ID NO: 75; (ii) a CDR2 having an amino acid sequence according to SEQ ID NO: 181; and (iii) a CDR3 having an amino acid sequence according to SEQ ID NO: 287; and the VL comprises (i) a CDR1 having an amino acid sequence according to SEQ ID NO: 393; (ii) a CDR2 having an amino acid sequence according to SEQ ID NO: 499; and (iii) a CDR3 having an amino acid sequence according to SEQ ID NO: 605.

In some embodiments, the VH comprises (i) a CDR1 having an amino acid sequence according to SEQ ID NO: 76; (ii) a CDR2 having an amino acid sequence according to SEQ ID NO: 182; and (iii) a CDR3 having an amino acid sequence according to SEQ ID NO: 288; and the VL comprises (i) a CDR1 having an amino acid sequence according to SEQ ID NO: 394; (ii) a CDR2 having an amino acid sequence according to SEQ ID NO: 500; and (iii) a CDR3 having an amino acid sequence according to SEQ ID NO: 606.

In some embodiments, the VH comprises (i) a CDR1 having an amino acid sequence according to SEQ ID NO: 77; (ii) a CDR2 having an amino acid sequence according to SEQ ID NO: 183; and (iii) a CDR3 having an amino acid sequence according to SEQ ID NO: 289; and the VL comprises (i) a CDR1 having an amino acid sequence according to SEQ ID NO: 395; (ii) a CDR2 having an amino acid sequence according to SEQ ID NO: 501; and (iii) a CDR3 having an amino acid sequence according to SEQ ID NO: 607.

In some embodiments, the VH comprises (i) a CDR1 having an amino acid sequence according to SEQ ID NO: 78; (ii) a CDR2 having an amino acid sequence according to SEQ ID NO: 184; and (iii) a CDR3 having an amino acid sequence according to SEQ ID NO: 290; and the VL comprises (i) a CDR1 having an amino acid sequence according to SEQ ID NO: 396; (ii) a CDR2 having an amino acid sequence according to SEQ ID NO: 502; and (iii) a CDR3 having an amino acid sequence according to SEQ ID NO: 608.

In some embodiments, the VH comprises (i) a CDR1 having an amino acid sequence according to SEQ ID NO: 79; (ii) a CDR2 having an amino acid sequence according to SEQ ID NO: 185; and (iii) a CDR3 having an amino acid sequence according to SEQ ID NO: 291; and the VL comprises (i) a CDR1 having an amino acid sequence according to SEQ ID NO: 397; (ii) a CDR2 having an amino acid sequence according to SEQ ID NO: 503; and (iii) a CDR3 having an amino acid sequence according to SEQ ID NO: 609.

In some embodiments, the VH comprises (i) a CDR1 having an amino acid sequence according to SEQ ID NO: 80; (ii) a CDR2 having an amino acid sequence according to SEQ ID NO: 186; and (iii) a CDR3 having an amino acid sequence according to SEQ ID NO: 292; and the VL comprises (i) a CDR1 having an amino acid sequence according to SEQ ID NO: 398; (ii) a CDR2 having an amino acid sequence according to SEQ ID NO: 504; and (iii) a CDR3 having an amino acid sequence according to SEQ ID NO: 610.

In some embodiments, the VH comprises (i) a CDR1 having an amino acid sequence according to SEQ ID NO: 84; (ii) a CDR2 having an amino acid sequence according to SEQ ID NO: 190; and (iii) a CDR3 having an amino acid sequence according to SEQ ID NO: 2%; and the VL comprises (i) a CDR1 having an amino acid sequence according to SEQ ID NO: 402; (ii) a CDR2 having an amino acid sequence according to SEQ ID NO: 508; and (iii) a CDR3 having an amino acid sequence according to SEQ ID NO: 614.

In some embodiments, the VH comprises (i) a CDR1 having an amino acid sequence according to SEQ ID NO: 85; (ii) a CDR2 having an amino acid sequence according to SEQ ID NO: 191; and (iii) a CDR3 having an amino acid sequence according to SEQ ID NO: 297; and the VL comprises (i) a CDR1 having an amino acid sequence according to SEQ ID NO: 403; (ii) a CDR2 having an amino acid sequence according to SEQ ID NO: 509; and (iii) a CDR3 having an amino acid sequence according to SEQ ID NO: 615.

In some embodiments, the VH comprises (i) a CDR1 having an amino acid sequence according to SEQ ID NO: 86; (ii) a CDR2 having an amino acid sequence according to SEQ ID NO: 192; and (iii) a CDR3 having an amino acid sequence according to SEQ ID NO: 298; and the VL comprises (i) a CDR1 having an amino acid sequence according to SEQ ID NO: 404; (ii) a CDR2 having an amino acid sequence according to SEQ ID NO: 510; and (iii) a CDR3 having an amino acid sequence according to SEQ ID NO: 616.

In some embodiments, the VH comprises (i) a CDR1 having an amino acid sequence according to SEQ ID NO: 87; (ii) a CDR2 having an amino acid sequence according to SEQ ID NO: 193; and (iii) a CDR3 having an amino acid sequence according to SEQ ID NO: 299; and the VL comprises (i) a CDR1 having an amino acid sequence according to SEQ ID NO: 405; (ii) a CDR2 having an amino acid sequence according to SEQ ID NO: 511; and (iii) a CDR3 having an amino acid sequence according to SEQ ID NO: 617.

In some embodiments, the VH comprises (i) a CDR1 having an amino acid sequence according to SEQ ID NO: 88; (ii) a CDR2 having an amino acid sequence according to SEQ ID NO: 194; and (iii) a CDR3 having an amino acid sequence according to SEQ ID NO: 300; and the VL comprises (i) a CDR1 having an amino acid sequence according to SEQ ID NO: 406; (ii) a CDR2 having an amino acid sequence according to SEQ ID NO: 512; and (iii) a CDR3 having an amino acid sequence according to SEQ ID NO: 618.

In some embodiments, the VH comprises (i) a CDR1 having an amino acid sequence according to SEQ ID NO: 89; (ii) a CDR2 having an amino acid sequence according to SEQ ID NO: 195; and (iii) a CDR3 having an amino acid sequence according to SEQ ID NO: 301; and the VL comprises (i) a CDR1 having an amino acid sequence according to SEQ ID NO: 407; (ii) a CDR2 having an amino acid sequence according to SEQ ID NO: 513; and (iii) a CDR3 having an amino acid sequence according to SEQ ID NO: 619.

In some embodiments, the VH comprises (i) a CDR1 having an amino acid sequence according to SEQ ID NO: 90; (ii) a CDR2 having an amino acid sequence according to SEQ ID NO: 196; and (iii) a CDR3 having an amino acid sequence according to SEQ ID NO: 302; and the VL comprises (i) a CDR1 having an amino acid sequence according to SEQ ID NO: 408; (ii) a CDR2 having an amino acid sequence according to SEQ ID NO: 514; and (iii) a CDR3 having an amino acid sequence according to SEQ ID NO: 620.

In some embodiments, the VH comprises (i) a CDR1 having an amino acid sequence according to SEQ ID NO: 91; (ii) a CDR2 having an amino acid sequence according to SEQ ID NO: 197; and (iii) a CDR3 having an amino acid sequence according to SEQ ID NO: 303; and the VL comprises (i) a CDR1 having an amino acid sequence according to SEQ ID NO: 409; (ii) a CDR2 having an amino acid sequence according to SEQ ID NO: 515; and (iii) a CDR3 having an amino acid sequence according to SEQ ID NO: 621.

In some embodiments, the VH comprises (i) a CDR1 having an amino acid sequence according to SEQ ID NO: 92; (ii) a CDR2 having an amino acid sequence according to SEQ ID NO: 198; and (iii) a CDR3 having an amino acid sequence according to SEQ ID NO: 304; and the VL comprises (i) a CDR1 having an amino acid sequence according to SEQ ID NO: 410; (ii) a CDR2 having an amino acid sequence according to SEQ ID NO: 516; and (iii) a CDR3 having an amino acid sequence according to SEQ ID NO: 622.

In some embodiments, the VH comprises (i) a CDR1 having an amino acid sequence according to SEQ ID NO: 93; (ii) a CDR2 having an amino acid sequence according to SEQ ID NO: 199; and (iii) a CDR3 having an amino acid sequence according to SEQ ID NO: 305; and the VL comprises (i) a CDR1 having an amino acid sequence according to SEQ ID NO: 411; (ii) a CDR2 having an amino acid sequence according to SEQ ID NO: 517; and (iii) a CDR3 having an amino acid sequence according to SEQ ID NO: 623.

In some embodiments, the VH comprises (i) a CDR1 having an amino acid sequence according to SEQ ID NO: 94; (ii) a CDR2 having an amino acid sequence according to SEQ ID NO: 200; and (iii) a CDR3 having an amino acid sequence according to SEQ ID NO: 306; and the VL comprises (i) a CDR1 having an amino acid sequence according to SEQ ID NO: 412; (ii) a CDR2 having an amino acid sequence according to SEQ ID NO: 518; and (iii) a CDR3 having an amino acid sequence according to SEQ ID NO: 624.

In some embodiments, the VH comprises (i) a CDR1 having an amino acid sequence according to SEQ ID NO: 95; (ii) a CDR2 having an amino acid sequence according to SEQ ID NO: 201; and (iii) a CDR3 having an amino acid sequence according to SEQ ID NO: 307; and the VL comprises (i) a CDR1 having an amino acid sequence according to SEQ ID NO: 413; (ii) a CDR2 having an amino acid sequence according to SEQ ID NO: 519; and (iii) a CDR3 having an amino acid sequence according to SEQ ID NO: 625.

In some embodiments, the VH comprises (i) a CDR1 having an amino acid sequence according to SEQ ID NO: 96; (ii) a CDR2 having an amino acid sequence according to SEQ ID NO: 202; and (iii) a CDR3 having an amino acid sequence according to SEQ ID NO: 308; and the VL comprises (i) a CDR1 having an amino acid sequence according to SEQ ID NO: 414; (ii) a CDR2 having an amino acid sequence according to SEQ ID NO: 520; and (iii) a CDR3 having an amino acid sequence according to SEQ ID NO: 626.

In some embodiments, the VH comprises (i) a CDR1 having an amino acid sequence according to SEQ ID NO: 97; (ii) a CDR2 having an amino acid sequence according to SEQ ID NO: 203; and (iii) a CDR3 having an amino acid sequence according to SEQ ID NO: 309; and the VL comprises (i) a CDR1 having an amino acid sequence according to SEQ ID NO: 415; (ii) a CDR2 having an amino acid sequence according to SEQ ID NO: 521; and (iii) a CDR3 having an amino acid sequence according to SEQ ID NO: 627.

In some embodiments, the VH comprises (i) a CDR1 having an amino acid sequence according to SEQ ID NO: 98; (ii) a CDR2 having an amino acid sequence according to SEQ ID NO: 204; and (iii) a CDR3 having an amino acid sequence according to SEQ ID NO: 310; and the VL comprises (i) a CDR1 having an amino acid sequence according to SEQ ID NO: 416; (ii) a CDR2 having an amino acid sequence according to SEQ ID NO: 522; and (iii) a CDR3 having an amino acid sequence according to SEQ ID NO: 628.

In some embodiments, the VH comprises (i) a CDR1 having an amino acid sequence according to SEQ ID NO: 99; (ii) a CDR2 having an amino acid sequence according to SEQ ID NO: 205; and (iii) a CDR3 having an amino acid sequence according to SEQ ID NO: 311; and the VL comprises (i) a CDR1 having an amino acid sequence according to SEQ ID NO: 417; (ii) a CDR2 having an amino acid sequence according to SEQ ID NO: 523; and (iii) a CDR3 having an amino acid sequence according to SEQ ID NO: 629.

In some embodiments, the VH comprises (i) a CDR1 having an amino acid sequence according to SEQ ID NO: 100; (ii) a CDR2 having an amino acid sequence according to SEQ ID NO: 206; and (iii) a CDR3 having an amino acid sequence according to SEQ ID NO: 312; and the VL comprises (i) a CDR1 having an amino acid sequence according to SEQ ID NO: 418; (ii) a CDR2 having an amino acid sequence according to SEQ ID NO: 524; and (iii) a CDR3 having an amino acid sequence according to SEQ ID NO: 630.

In some embodiments, the VH comprises (i) a CDR1 having an amino acid sequence according to SEQ ID NO: 101; (ii) a CDR2 having an amino acid sequence according to SEQ ID NO: 207; and (iii) a CDR3 having an amino acid sequence according to SEQ ID NO: 313; and the VL comprises (i) a CDR1 having an amino acid sequence according to SEQ ID NO: 419; (ii) a CDR2 having an amino acid sequence according to SEQ ID NO: 525; and (iii) a CDR3 having an amino acid sequence according to SEQ ID NO: 631.

In some embodiments, the VH comprises (i) a CDR1 having an amino acid sequence according to SEQ ID NO: 102; (ii) a CDR2 having an amino acid sequence according to SEQ ID NO: 208; and (iii) a CDR3 having an amino acid sequence according to SEQ ID NO: 314; and the VL comprises (i) a CDR1 having an amino acid sequence according to SEQ ID NO: 420; (ii) a CDR2 having an amino acid sequence according to SEQ ID NO: 526; and (iii) a CDR3 having an amino acid sequence according to SEQ ID NO: 632.

In some embodiments, the VH comprises (i) a CDR1 having an amino acid sequence according to SEQ ID NO: 103; (ii) a CDR2 having an amino acid sequence according to SEQ ID NO: 209; and (iii) a CDR3 having an amino acid sequence according to SEQ ID NO: 315; and the VL comprises (i) a CDR1 having an amino acid sequence according to SEQ ID NO: 421; (ii) a CDR2 having an amino acid sequence according to SEQ ID NO: 527; and (iii) a CDR3 having an amino acid sequence according to SEQ ID NO: 633.

In some embodiments, the VH comprises (i) a CDR1 having an amino acid sequence according to SEQ ID NO: 104; (ii) a CDR2 having an amino acid sequence according to SEQ ID NO: 210; and (iii) a CDR3 having an amino acid sequence according to SEQ ID NO: 316; and the VL comprises (i) a CDR1 having an amino acid sequence according to SEQ ID NO: 422; (ii) a CDR2 having an amino acid sequence according to SEQ ID NO: 528; and (iii) a CDR3 having an amino acid sequence according to SEQ ID NO: 634.

In some embodiments, the VH comprises (i) a CDR1 having an amino acid sequence according to SEQ ID NO: 105; (ii) a CDR2 having an amino acid sequence according to SEQ ID NO: 211; and (iii) a CDR3 having an amino acid sequence according to SEQ ID NO: 317; and the VL comprises (i) a CDR1 having an amino acid sequence according to SEQ ID NO: 423; (ii) a CDR2 having an amino acid sequence according to SEQ ID NO: 529; and (iii) a CDR3 having an amino acid sequence according to SEQ ID NO: 635.

In some embodiments, the VH comprises (i) a CDR1 having an amino acid sequence according to SEQ ID NO: 106; (ii) a CDR2 having an amino acid sequence according to SEQ ID NO: 212; and (iii) a CDR3 having an amino acid sequence according to SEQ ID NO: 318; and the VL comprises (i) a CDR1 having an amino acid sequence according to SEQ ID NO: 424; (ii) a CDR2 having an amino acid sequence according to SEQ ID NO: 530; and (iii) a CDR3 having an amino acid sequence according to SEQ ID NO: 636.

In some embodiments, the VH comprises a sequence having at least 80% sequence identity to the amino acid sequence of any one of SEQ ID NOs: 1915-1934, 1940-1966, 1968-1988, and 1992-2014; and the VL comprises a sequence having at least 80% sequence identity to the amino acid sequence of any one of SEQ ID NOs: 2021-2040, 2046-2072, 2074-2094, and 2098-2120.

In some embodiments, the VH comprises a sequence having at least 80% sequence identity to the amino acid sequence of SEQ ID NO: 127 and the VL comprises a sequence having at least 80% sequence identity to the amino acid sequence of SEQ ID NO: 134.

In some embodiments, the VH comprises a sequence having at least 80% sequence identity to the amino acid sequence of SEQ ID NO: 1915 and the VL comprises a sequence having at least 80% sequence identity to the amino acid sequence of SEQ ID NO: 2021.

In some embodiments, the VH comprises a sequence having at least 80% sequence identity to the amino acid sequence of SEQ ID NO: 1916 and the VL comprises a sequence having at least 80% sequence identity to the amino acid sequence of SEQ ID NO: 2022.

In some embodiments, the VH comprises a sequence having at least 80% sequence identity to the amino acid sequence of SEQ ID NO: 1917 and the VL comprises a sequence having at least 80% sequence identity to the amino acid sequence of SEQ ID NO: 2023.

In some embodiments, the VH comprises a sequence having at least 80% sequence identity to the amino acid sequence of SEQ ID NO: 1918 and the VL comprises a sequence having at least 80% sequence identity to the amino acid sequence of SEQ ID NO: 2024.

In some embodiments, the VH comprises a sequence having at least 80% sequence identity to the amino acid sequence of SEQ ID NO: 1919 and the VL comprises a sequence having at least 80% sequence identity to the amino acid sequence of SEQ ID NO: 2025.

In some embodiments, the VH comprises a sequence having at least 80% sequence identity to the amino acid sequence of SEQ ID NO: 1920 and the VL comprises a sequence having at least 80% sequence identity to the amino acid sequence of SEQ ID NO: 2026.

In some embodiments, the VH comprises a sequence having at least 80% sequence identity to the amino acid sequence of SEQ ID NO: 1921 and the VL comprises a sequence having at least 80% sequence identity to the amino acid sequence of SEQ ID NO: 2027.

In some embodiments, the VH comprises a sequence having at least 80% sequence identity to the amino acid sequence of SEQ ID NO: 1922 and the VL comprises a sequence having at least 80% sequence identity to the amino acid sequence of SEQ ID NO: 2028.

In some embodiments, the VH comprises a sequence having at least 80% sequence identity to the amino acid sequence of SEQ ID NO: 1923 and the VL comprises a sequence having at least 80% sequence identity to the amino acid sequence of SEQ ID NO: 2029.

In some embodiments, the VH comprises a sequence having at least 80% sequence identity to the amino acid sequence of SEQ ID NO: 1924 and the VL comprises a sequence having at least 80% sequence identity to the amino acid sequence of SEQ ID NO: 2030.

In some embodiments, the VH comprises a sequence having at least 80% sequence identity to the amino acid sequence of SEQ ID NO: 1925 and the VL comprises a sequence having at least 80% sequence identity to the amino acid sequence of SEQ ID NO: 2031.

In some embodiments, the VH comprises a sequence having at least 80% sequence identity to the amino acid sequence of SEQ ID NO: 1926 and the VL comprises a sequence having at least 80% sequence identity to the amino acid sequence of SEQ ID NO: 2032.

In some embodiments, the VH comprises a sequence having at least 80% sequence identity to the amino acid sequence of SEQ ID NO: 1927 and the VL comprises a sequence having at least 80% sequence identity to the amino acid sequence of SEQ ID NO: 2033.

In some embodiments, the VH comprises a sequence having at least 80% sequence identity to the amino acid sequence of SEQ ID NO: 1928 and the VL comprises a sequence having at least 80% sequence identity to the amino acid sequence of SEQ ID NO: 2034.

In some embodiments, the VH comprises a sequence having at least 80% sequence identity to the amino acid sequence of SEQ ID NO: 1929 and the VL comprises a sequence having at least 80% sequence identity to the amino acid sequence of SEQ ID NO: 2035.

In some embodiments, the VH comprises a sequence having at least 80% sequence identity to the amino acid sequence of SEQ ID NO: 1930 and the VL comprises a sequence having at least 80% sequence identity to the amino acid sequence of SEQ ID NO: 2036.

In some embodiments, the VH comprises a sequence having at least 80% sequence identity to the amino acid sequence of SEQ ID NO: 1931 and the VL comprises a sequence having at least 80% sequence identity to the amino acid sequence of SEQ ID NO: 2037.

In some embodiments, the VH comprises a sequence having at least 80% sequence identity to the amino acid sequence of SEQ ID NO: 1932 and the VL comprises a sequence having at least 80% sequence identity to the amino acid sequence of SEQ ID NO: 2038.

In some embodiments, the VH comprises a sequence having at least 80% sequence identity to the amino acid sequence of SEQ ID NO: 1933 and the VL comprises a sequence having at least 80% sequence identity to the amino acid sequence of SEQ ID NO: 2039.

In some embodiments, the VH comprises a sequence having at least 80% sequence identity to the amino acid sequence of SEQ ID NO: 1934 and the VL comprises a sequence having at least 80% sequence identity to the amino acid sequence of SEQ ID NO: 2040.

In some embodiments, the VH comprises a sequence having at least 80% sequence identity to the amino acid sequence of SEQ ID NO: 1940 and the VL comprises a sequence having at least 80% sequence identity to the amino acid sequence of SEQ ID NO: 2046.

In some embodiments, the VH comprises a sequence having at least 80% sequence identity to the amino acid sequence of SEQ ID NO: 1941 and the VL comprises a sequence having at least 80% sequence identity to the amino acid sequence of SEQ ID NO: 2047.

In some embodiments, the VH comprises a sequence having at least 80% sequence identity to the amino acid sequence of SEQ ID NO: 1942 and the VL comprises a sequence having at least 80% sequence identity to the amino acid sequence of SEQ ID NO: 2048.

In some embodiments, the VH comprises a sequence having at least 80% sequence identity to the amino acid sequence of SEQ ID NO: 1943 and the VL comprises a sequence having at least 80% sequence identity to the amino acid sequence of SEQ ID NO: 2049.

In some embodiments, the VH comprises a sequence having at least 80% sequence identity to the amino acid sequence of SEQ ID NO: 1944 and the VL comprises a sequence having at least 80% sequence identity to the amino acid sequence of SEQ ID NO: 2050.

In some embodiments, the VH comprises a sequence having at least 80% sequence identity to the amino acid sequence of SEQ ID NO: 1945 and the VL comprises a sequence having at least 80% sequence identity to the amino acid sequence of SEQ ID NO: 2051.

In some embodiments, the VH comprises a sequence having at least 80% sequence identity to the amino acid sequence of SEQ ID NO: 1946 and the VL comprises a sequence having at least 80% sequence identity to the amino acid sequence of SEQ ID NO: 2052.

In some embodiments, the VH comprises a sequence having at least 80% sequence identity to the amino acid sequence of SEQ ID NO: 1947 and the VL comprises a sequence having at least 80% sequence identity to the amino acid sequence of SEQ ID NO: 2053.

In some embodiments, the VH comprises a sequence having at least 80% sequence identity to the amino acid sequence of SEQ ID NO: 1948 and the VL comprises a sequence having at least 80% sequence identity to the amino acid sequence of SEQ ID NO: 2054.

In some embodiments, the VH comprises a sequence having at least 80% sequence identity to the amino acid sequence of SEQ ID NO: 1949 and the VL comprises a sequence having at least 80% sequence identity to the amino acid sequence of SEQ ID NO: 2055.

In some embodiments, the VH comprises a sequence having at least 80% sequence identity to the amino acid sequence of SEQ ID NO: 1950 and the VL comprises a sequence having at least 80% sequence identity to the amino acid sequence of SEQ ID NO: 2056.

In some embodiments, the VH comprises a sequence having at least 80% sequence identity to the amino acid sequence of SEQ ID NO: 1951 and the VL comprises a sequence having at least 80% sequence identity to the amino acid sequence of SEQ ID NO: 2057.

In some embodiments, the VH comprises a sequence having at least 80% sequence identity to the amino acid sequence of SEQ ID NO: 1952 and the VL comprises a sequence having at least 80% sequence identity to the amino acid sequence of SEQ ID NO: 2058.

In some embodiments, the VH comprises a sequence having at least 80% sequence identity to the amino acid sequence of SEQ ID NO: 1953 and the VL comprises a sequence having at least 80% sequence identity to the amino acid sequence of SEQ ID NO: 2059.

In some embodiments, the VH comprises a sequence having at least 80% sequence identity to the amino acid sequence of SEQ ID NO: 1954 and the VL comprises a sequence having at least 80% sequence identity to the amino acid sequence of SEQ ID NO: 2060.

In some embodiments, the VH comprises a sequence having at least 80% sequence identity to the amino acid sequence of SEQ ID NO: 1955 and the VL comprises a sequence having at least 80% sequence identity to the amino acid sequence of SEQ ID NO: 2061.

In some embodiments, the VH comprises a sequence having at least 80% sequence identity to the amino acid sequence of SEQ ID NO: 1956 and the VL comprises a sequence having at least 80% sequence identity to the amino acid sequence of SEQ ID NO: 2062.

In some embodiments, the VH comprises a sequence having at least 80% sequence identity to the amino acid sequence of SEQ ID NO: 1957 and the VL comprises a sequence having at least 80% sequence identity to the amino acid sequence of SEQ ID NO: 2063.

In some embodiments, the VH comprises a sequence having at least 80% sequence identity to the amino acid sequence of SEQ ID NO: 1958 and the VL comprises a sequence having at least 80% sequence identity to the amino acid sequence of SEQ ID NO: 2064.

In some embodiments, the VH comprises a sequence having at least 80% sequence identity to the amino acid sequence of SEQ ID NO: 1959 and the VL comprises a sequence having at least 80% sequence identity to the amino acid sequence of SEQ ID NO: 2065.

In some embodiments, the VH comprises a sequence having at least 80% sequence identity to the amino acid sequence of SEQ ID NO: 1960 and the VL comprises a sequence having at least 80% sequence identity to the amino acid sequence of SEQ ID NO: 2066.

In some embodiments, the VH comprises a sequence having at least 80% sequence identity to the amino acid sequence of SEQ ID NO: 1961 and the VL comprises a sequence having at least 80% sequence identity to the amino acid sequence of SEQ ID NO: 2067.

In some embodiments, the VH comprises a sequence having at least 80% sequence identity to the amino acid sequence of SEQ ID NO: 1962 and the VL comprises a sequence having at least 80% sequence identity to the amino acid sequence of SEQ ID NO: 2068.

In some embodiments, the VH comprises a sequence having at least 80% sequence identity to the amino acid sequence of SEQ ID NO: 1963 and the VL comprises a sequence having at least 80% sequence identity to the amino acid sequence of SEQ ID NO: 2069.

In some embodiments, the VH comprises a sequence having at least 80% sequence identity to the amino acid sequence of SEQ ID NO: 1964 and the VL comprises a sequence having at least 80% sequence identity to the amino acid sequence of SEQ ID NO: 2070.

In some embodiments, the VH comprises a sequence having at least 80% sequence identity to the amino acid sequence of SEQ ID NO: 1965 and the VL comprises a sequence having at least 80% sequence identity to the amino acid sequence of SEQ ID NO: 2071.

In some embodiments, the VH comprises a sequence having at least 80% sequence identity to the amino acid sequence of SEQ ID NO: 1966 and the VL comprises a sequence having at least 80% sequence identity to the amino acid sequence of SEQ ID NO: 2072.

In some embodiments, the VH comprises a sequence having at least 80% sequence identity to the amino acid sequence of SEQ ID NO: 1968 and the VL comprises a sequence having at least 80% sequence identity to the amino acid sequence of SEQ ID NO: 2074.

In some embodiments, the VH comprises a sequence having at least 80% sequence identity to the amino acid sequence of SEQ ID NO: 1969 and the VL comprises a sequence having at least 80% sequence identity to the amino acid sequence of SEQ ID NO: 2075.

In some embodiments, the VH comprises a sequence having at least 80% sequence identity to the amino acid sequence of SEQ ID NO: 1970 and the VL comprises a sequence having at least 80% sequence identity to the amino acid sequence of SEQ ID NO: 2076.

In some embodiments, the VH comprises a sequence having at least 80% sequence identity to the amino acid sequence of SEQ ID NO: 1971 and the VL comprises a sequence having at least 80% sequence identity to the amino acid sequence of SEQ ID NO: 2077.

In some embodiments, the VH comprises a sequence having at least 80% sequence identity to the amino acid sequence of SEQ ID NO: 1972 and the VL comprises a sequence having at least 80% sequence identity to the amino acid sequence of SEQ ID NO: 2078.

In some embodiments, the VH comprises a sequence having at least 80% sequence identity to the amino acid sequence of SEQ ID NO: 1973 and the VL comprises a sequence having at least 80% sequence identity to the amino acid sequence of SEQ ID NO: 2079.

In some embodiments, the VH comprises a sequence having at least 80% sequence identity to the amino acid sequence of SEQ ID NO: 1974 and the VL comprises a sequence having at least 80% sequence identity to the amino acid sequence of SEQ ID NO: 2080.

In some embodiments, the VH comprises a sequence having at least 80% sequence identity to the amino acid sequence of SEQ ID NO: 1975 and the VL comprises a sequence having at least 80% sequence identity to the amino acid sequence of SEQ ID NO: 2081.

In some embodiments, the VH comprises a sequence having at least 80% sequence identity to the amino acid sequence of SEQ ID NO: 1976 and the VL comprises a sequence having at least 80% sequence identity to the amino acid sequence of SEQ ID NO: 2082.

In some embodiments, the VH comprises a sequence having at least 80% sequence identity to the amino acid sequence of SEQ ID NO: 1977 and the VL comprises a sequence having at least 80% sequence identity to the amino acid sequence of SEQ ID NO: 2083.

In some embodiments, the VH comprises a sequence having at least 80% sequence identity to the amino acid sequence of SEQ ID NO: 1978 and the VL comprises a sequence having at least 80% sequence identity to the amino acid sequence of SEQ ID NO: 2084.

In some embodiments, the VH comprises a sequence having at least 80% sequence identity to the amino acid sequence of SEQ ID NO: 1979 and the VL comprises a sequence having at least 80% sequence identity to the amino acid sequence of SEQ ID NO: 2085.

In some embodiments, the VH comprises a sequence having at least 80% sequence identity to the amino acid sequence of SEQ ID NO: 1980 and the VL comprises a sequence having at least 80% sequence identity to the amino acid sequence of SEQ ID NO: 2086.

In some embodiments, the VH comprises a sequence having at least 80% sequence identity to the amino acid sequence of SEQ ID NO: 1981 and the VL comprises a sequence having at least 80% sequence identity to the amino acid sequence of SEQ ID NO: 2087.

In some embodiments, the VH comprises a sequence having at least 80% sequence identity to the amino acid sequence of SEQ ID NO: 1982 and the VL comprises a sequence having at least 80% sequence identity to the amino acid sequence of SEQ ID NO: 2088.

In some embodiments, the VH comprises a sequence having at least 80% sequence identity to the amino acid sequence of SEQ ID NO: 1983 and the VL comprises a sequence having at least 80% sequence identity to the amino acid sequence of SEQ ID NO: 2089.

In some embodiments, the VH comprises a sequence having at least 80% sequence identity to the amino acid sequence of SEQ ID NO: 1984 and the VL comprises a sequence having at least 80% sequence identity to the amino acid sequence of SEQ ID NO: 2090.

In some embodiments, the VH comprises a sequence having at least 80% sequence identity to the amino acid sequence of SEQ ID NO: 1985 and the VL comprises a sequence having at least 80% sequence identity to the amino acid sequence of SEQ ID NO: 2091.

In some embodiments, the VH comprises a sequence having at least 80% sequence identity to the amino acid sequence of SEQ ID NO: 1986 and the VL comprises a sequence having at least 80% sequence identity to the amino acid sequence of SEQ ID NO: 2092.

In some embodiments, the VH comprises a sequence having at least 80% sequence identity to the amino acid sequence of SEQ ID NO: 1987 and the VL comprises a sequence having at least 80% sequence identity to the amino acid sequence of SEQ ID NO: 2093.

In some embodiments, the VH comprises a sequence having at least 80% sequence identity to the amino acid sequence of SEQ ID NO: 1992 and the VL comprises a sequence having at least 80% sequence identity to the amino acid sequence of SEQ ID NO: 2098.

In some embodiments, the VH comprises a sequence having at least 80% sequence identity to the amino acid sequence of SEQ ID NO: 1993 and the VL comprises a sequence having at least 80% sequence identity to the amino acid sequence of SEQ ID NO: 2099.

In some embodiments, the VH comprises a sequence having at least 80% sequence identity to the amino acid sequence of SEQ ID NO: 1994 and the VL comprises a sequence having at least 80% sequence identity to the amino acid sequence of SEQ ID NO: 2100.

In some embodiments, the VH comprises a sequence having at least 80% sequence identity to the amino acid sequence of SEQ ID NO: 1995 and the VL comprises a sequence having at least 80% sequence identity to the amino acid sequence of SEQ ID NO: 2101.

In some embodiments, the VH comprises a sequence having at least 80% sequence identity to the amino acid sequence of SEQ ID NO: 1996 and the VL comprises a sequence having at least 80% sequence identity to the amino acid sequence of SEQ ID NO: 2102.

In some embodiments, the VH comprises a sequence having at least 80% sequence identity to the amino acid sequence of SEQ ID NO: 1997 and the VL comprises a sequence having at least 80% sequence identity to the amino acid sequence of SEQ ID NO: 2103.

In some embodiments, the VH comprises a sequence having at least 80% sequence identity to the amino acid sequence of SEQ ID NO: 1998 and the VL comprises a sequence having at least 80% sequence identity to the amino acid sequence of SEQ ID NO: 2104.

In some embodiments, the VH comprises a sequence having at least 80% sequence identity to the amino acid sequence of SEQ ID NO: 1999 and the VL comprises a sequence having at least 80% sequence identity to the amino acid sequence of SEQ ID NO: 2105.

In some embodiments, the VH comprises a sequence having at least 80% sequence identity to the amino acid sequence of SEQ ID NO: 2000 and the VL comprises a sequence having at least 80% sequence identity to the amino acid sequence of SEQ ID NO: 2106.

In some embodiments, the VH comprises a sequence having at least 80% sequence identity to the amino acid sequence of SEQ ID NO: 2001 and the VL comprises a sequence having at least 80% sequence identity to the amino acid sequence of SEQ ID NO: 2107.

In some embodiments, the VH comprises a sequence having at least 80% sequence identity to the amino acid sequence of SEQ ID NO: 2002 and the VL comprises a sequence having at least 80% sequence identity to the amino acid sequence of SEQ ID NO: 2108.

In some embodiments, the VH comprises a sequence having at least 80% sequence identity to the amino acid sequence of SEQ ID NO: 2003 and the VL comprises a sequence having at least 80% sequence identity to the amino acid sequence of SEQ ID NO: 2109.

In some embodiments, the VH comprises a sequence having at least 80% sequence identity to the amino acid sequence of SEQ ID NO: 2004 and the VL comprises a sequence having at least 80% sequence identity to the amino acid sequence of SEQ ID NO: 2110.

In some embodiments, the VH comprises a sequence having at least 80% sequence identity to the amino acid sequence of SEQ ID NO: 2005 and the VL comprises a sequence having at least 80% sequence identity to the amino acid sequence of SEQ ID NO: 2111.

In some embodiments, the VH comprises a sequence having at least 80% sequence identity to the amino acid sequence of SEQ ID NO: 2006 and the VL comprises a sequence having at least 80% sequence identity to the amino acid sequence of SEQ ID NO: 2112.

In some embodiments, the VH comprises a sequence having at least 80% sequence identity to the amino acid sequence of SEQ ID NO: 2007 and the VL comprises a sequence having at least 80% sequence identity to the amino acid sequence of SEQ ID NO: 2113.

In some embodiments, the VH comprises a sequence having at least 80% sequence identity to the amino acid sequence of SEQ ID NO: 2008 and the VL comprises a sequence having at least 80% sequence identity to the amino acid sequence of SEQ ID NO: 2114.

In some embodiments, the VH comprises a sequence having at least 80% sequence identity to the amino acid sequence of SEQ ID NO: 2009 and the VL comprises a sequence having at least 80% sequence identity to the amino acid sequence of SEQ ID NO: 2115.

In some embodiments, the VH comprises a sequence having at least 80% sequence identity to the amino acid sequence of SEQ ID NO: 2010 and the VL comprises a sequence having at least 80% sequence identity to the amino acid sequence of SEQ ID NO: 2116.

In some embodiments, the VH comprises a sequence having at least 80% sequence identity to the amino acid sequence of SEQ ID NO: 2011 and the VL comprises a sequence having at least 80% sequence identity to the amino acid sequence of SEQ ID NO: 2117.

In some embodiments, the VH comprises a sequence having at least 80% sequence identity to the amino acid sequence of SEQ ID NO: 2012 and the VL comprises a sequence having at least 80% sequence identity to the amino acid sequence of SEQ ID NO: 2118.

In some embodiments, the VH comprises a sequence having at least 80% sequence identity to the amino acid sequence of SEQ ID NO: 2013 and the VL comprises a sequence having at least 80% sequence identity to the amino acid sequence of SEQ ID NO: 2119.

In some embodiments, the VH comprises a sequence having at least 80% sequence identity to the amino acid sequence of SEQ ID NO: 2014 and the VL comprises a sequence having at least 80% sequence identity to the amino acid sequence of SEQ ID NO: 2120.

Described herein, in certain embodiments, are α4β7 binding proteins comprising: a) a heavy chain variable region (VH) comprising the amino acid sequence according to any one of SEQ ID NOs: 1909, 1910, 1935-1939, 1967; and b) a light chain variable region (VL) comprising the amino acid sequence according to any one of SEQ ID NOs: 2015, 2016, 2041-2045, 2073.

In some embodiments, the VH comprises the amino acid sequence according to SEQ ID NO: 1909; and the VL comprises the amino acid sequence according to SEQ ID NO: 2015.

In some embodiments, the VH comprises the amino acid sequence according to SEQ ID NO: 1910; and the VL comprises the amino acid sequence according to SEQ ID NO: 2016.

In some embodiments, the VH comprises the amino acid sequence according to SEQ ID NO: 1935; and the VL comprises the amino acid sequence according to SEQ ID NO: 2041.

In some embodiments, the VH comprises the amino acid sequence according to SEQ ID NO: 1936; and the VL comprises the amino acid sequence according to SEQ ID NO: 2042.

In some embodiments, the VH comprises the amino acid sequence according to SEQ ID NO: 1937; and the VL comprises the amino acid sequence according to SEQ ID NO: 2043.

In some embodiments, the VH comprises the amino acid sequence according to SEQ ID NO: 1938; and the VL comprises the amino acid sequence according to SEQ ID NO: 2044.

In some embodiments, the VH comprises the amino acid sequence according to SEQ ID NO: 1939; and the VL comprises the amino acid sequence according to SEQ ID NO: 2045.

In some embodiments, the VH comprises the amino acid sequence according to SEQ ID NO: 1967; and the VL comprises the amino acid sequence according to SEQ ID NO: 2073.

Described herein, in certain embodiments, are α4β7 binding proteins comprising: a) a heavy chain variable region (VH) comprising (i) a CDR1 having an amino acid sequence according to any one of SEQ ID NOs: 1-106, (ii) a CDR2 having an amino acid sequence according to any one of SEQ ID NOs: 107-212, and (iii) a CDR3 having an amino acid sequence according to any one of SEQ ID NOs: 213-318; b) a light chain variable region (VL) comprising (i) a CDR1 having an amino acid sequence according to any one of SEQ ID NOs: 319-424, (ii) a CDR2 having an amino acid sequence according to any one of SEQ ID NOs: 425-530, and (iii) a CDR3 having an amino acid sequence according to any one of SEQ ID NOs: 531-636; and c) a modified Fc that comprises amino acid modifications M252Y, S254T, and T256E (YTE) and/or L234A/G237A (LAGA).

Described herein, in certain embodiments, are α4β7 binding proteins comprising: a) a heavy chain variable region (VH) comprising (i) a CDR1 having an amino acid sequence according to any one of SEQ ID NOs: 1-106, (ii) a CDR2 having an amino acid sequence according to any one of SEQ ID NOs: 107-212, and (iii) a CDR3 having an amino acid sequence according to any one of SEQ ID NOs: 213-318; b) a light chain variable region (VL) comprising (i) a CDR1 having an amino acid sequence according to any one of SEQ ID NOs: 319-424, (ii) a CDR2 having an amino acid sequence according to any one of SEQ ID NOs: 425-530, and (iii) a CDR3 having an amino acid sequence according to any one of SEQ ID NOs: 531-636; and c) a modified Fc that extends half-life of the α4β7 binding protein as compared to an α4β7 binding protein that does not comprise the modified Fc.

Described herein, in certain embodiments, are α4β7 binding proteins, wherein the α4β7 binding protein specifically binds to an epitope of α4β7 and comprises a Fc domain comprising amino acid modifications M252Y, S254T, and T256E (YTE) and/or L234A/G237A (LAGA).

In some embodiments, the Fc is an IgG1, IgG2 or IgG4 immunoglobulin Fc domain.

In some embodiments, the Fc is an IgG1 immunoglobulin domain.

In some embodiments, the Fc is an IgG2 immunoglobulin domain.

In some embodiments, the Fc is an IgG4 immunoglobulin domain.

In some embodiments, the α4β7 binding protein is an antibody.

Aspects of the disclosure relate to compositions comprising the α4β7 binding proteins described herein and a pharmaceutically acceptable carrier. Also provided herein are injectable liquid compositions comprising the α4β7 binding proteins described herein and a pharmaceutically acceptable carrier.

Aspects of the disclosure relate to nucleic acid encoding the α4β7 binding proteins described herein. In some embodiments, provided herein are recombinant host cells comprised the nucleic acid encoding the α4β7 binding proteins described herein.

Aspects of the disclosure relate to methods of treating an inflammatory bowel disease in a patient in need thereof, the method comprising subcutaneously or intravenously administering to the patient an effective amount of an α4β7 binding protein described herein. In some embodiments, the inflammatory bowel disease is Crohn's disease or ulcerative colitis. In some embodiments, the inflammatory bowel disease is ulcerative colitis. In some embodiments, the inflammatory bowel disease is Crohn's disease. In some embodiments, administration of the α4β7 binding protein is subcutaneous. In some embodiments, administration of the α4β7 binding protein is intravenous.

Aspects of the disclosure relate to methods of treating an inflammatory disease in a patient in need thereof, the method comprising subcutaneously or intravenously administering to the patient an effective amount of an α4β7 binding protein described herein. In some embodiments, the inflammatory disease is hidradenitis suppurativa. In some embodiments, administration of the α4β7 binding protein is subcutaneous. In some embodiments, administration of the α4β7 binding protein is intravenous.

DETAILED DESCRIPTION

Figures 1, 2:
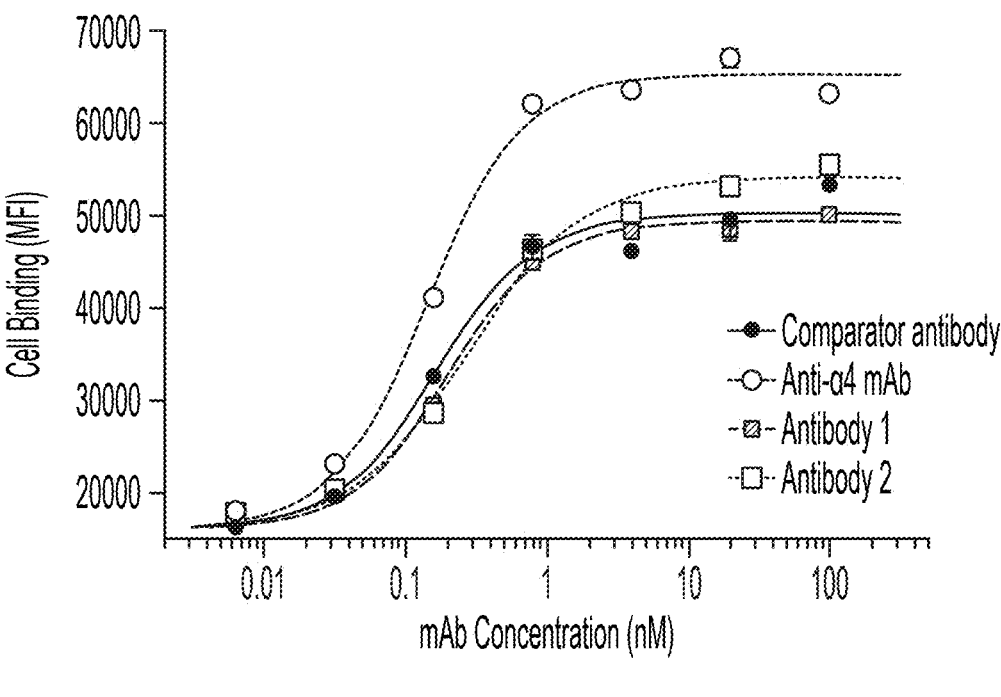
FIG. 1 depicts binding curves for increasing concentrations of an anti-α4β7 comparator antibody, a control anti-α4 antibody, and exemplary antibodies Antibody 1 and Antibody 2 incubated with the RPMI-8866 cell line that expresses only α4β7 integrin as determined by flow cytometry analysis. X-axis depicts antibody concentration in nanomolar (nM) and y-axis depicts cell binding as mean fluorescent intensity (MFI).
FIG. 2 depicts binding curves for increasing concentrations of an anti-α4β7 comparator antibody, a control anti-α4 antibody, and exemplary antibodies Antibody 1 and Antibody 2 incubated with the Ramos cell line that expresses only α4 as determined by flow cytometry analysis. X-axis depicts antibody concentration in nanomolar (nM) and y-axis depicts cell binding as mean fluorescent intensity (MFI).

To facilitate an understanding of the present disclosure, a number of terms and phrases are defined below.

As used herein, unless otherwise indicated, the term "antibody" is understood to mean an intact antibody (e.g., an intact monoclonal antibody), or a fragment thereof, such as a Fc fragment of an antibody (e.g., an Fc fragment of a monoclonal antibody), or an antigen-binding fragment of an antibody (e.g., an antigen-binding fragment of a monoclonal antibody), including an intact antibody, antigen-binding fragment, or Fc fragment that has been modified, engineered, or chemically conjugated. In general, antibodies are multimeric proteins that contain four polypeptide chains. Two of the polypeptide chains are called immunoglobulin heavy chains (H chains), and two of the polypeptide chains are called immunoglobulin light chains (L chains). The immunoglobulin heavy and light chains are connected by an interchain disulfide bond. The immunoglobulin heavy chains are connected by interchain disulfide bonds. A light chain consists of one variable region (VL) and one constant region (CL). The heavy chain consists of one variable region (VH) and at least three constant regions (CH1, CH2 and CH3). The variable regions determine the binding specificity of the antibody. Each variable region contains three hypervariable regions known as complementarity determining regions (CDRs) flanked by four relatively conserved regions known as framework regions (FRs). The extent of the FRs and CDRs has been defined (Kabat, E. A., et al. (1991) Sequences of Proteins of Immunological Interest, Fifth Edition, U.S. Department of Health and Human Services, NIH Publication No. 91-3242; and Chothia, C. et al. (1987) J. Mol. Biol. 196:901-917). The three CDRs, referred to as CDR1, CDR2, and CDR3, contribute to the antibody binding specificity. Naturally occurring antibodies have been used as starting material for engineered antibodies, such as chimeric antibodies and humanized antibodies. Examples of antibody-based antigen-binding fragments include Fab, Fab', (Fab')2, Fv, single chain antibodies (e.g., scFv), minibodies, and diabodies. Examples of antibodies that have been modified or engineered include chimeric antibodies, humanized antibodies, and multispecific antibodies (e.g., bispecific antibodies). An example of a chemically conjugated antibody is an antibody conjugated to a toxin moiety.

The terms "variable domain" and "variable region" are used interchangeably and refer to the portions of the antibody or immunoglobulin domains that exhibit variability in their sequence and that are involved in determining the specificity and binding affinity of a particular antibody. Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three-dimensional space to form an antigen-binding surface.

An "Fc polypeptide" of a dimeric Fc as used herein refers to one of the two polypeptides forming the dimeric Fc domain, i.e. a polypeptide comprising C-terminal constant regions of an immunoglobulin heavy chain, capable of stable self-association. For example, an Fc polypeptide of a dimeric IgG Fc comprises an IgG CH2 and an IgG CH3 constant domain sequence. An Fc can be of the class IgA, IgD, IgE, IgG, and IgM. These classes are also designated α, δ, ε, γ, and μ, respectively. Several of these may be further divided into subclasses (isotypes), e.g., IgG1, IgG2, IgG3, IgG4, IgA1, and IgA2.

The terms "Fc receptor" and "FcR" are used to describe a receptor that binds to the Fc region of an antibody. For example, an FcR can be a native sequence human FcR. Generally, an FcR is one which binds an IgG antibody (a gamma receptor) and includes receptors of the FcγRI, FcγRII, and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. Immunoglobulins of other isotypes can also be bound by certain FcRs (see, e.g., Janeway et al., *Immuno Biology*: the immune system in health and disease, (Elsevier Science Ltd., NY) (4th ed., 1999)). Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain (reviewed in Dafron, *Annu. Rev. Immunol.* 15:203-234 (1997)). FcRs are reviewed in Ravetch and Kinet, *Annu. Rev. Immunol* 9:457-92 (1991); Capel et al., *Immunometh-ods* 4:25-34 (1994); and de Haas et al., J. Lab. Clin. Med. 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., *J. Immunol.* 117:587 (1976); and Kim et al., *J. Immunol.* 24:249 (1994)).

The terms "recipient", "individual", "subject", "host", and "patient", are used interchangeably herein and in some embodiments, refer to any mammalian subject for whom diagnosis, treatment, or therapy is desired, particularly humans. "Mammal" for purposes of treatment refers to any animal classified as a mammal, including humans, domestic and farm animals, and laboratory, zoo, sports, or pet animals, such as dogs, horses, cats, cows, sheep, goats, pigs, mice, rats, rabbits, guinea pigs, monkeys etc. In some embodiments, the mammal is human. None of these terms require the supervision of medical personnel.

As used herein, the term "effective amount" refers to the amount of a compound (e.g., a compound of the present disclosure) sufficient to effect beneficial or desired results. An effective amount can be administered in one or more administrations, applications or dosages and is not intended to be limited to a particular formulation or administration route. As used herein, the term "treating" includes any effect, e.g., lessening, reducing, modulating, ameliorating or eliminating, that results in the improvement of the condition, disease, disorder, and the like, or ameliorating a symptom thereof.

As used herein, the term "pharmaceutical composition" refers to the combination of an active agent with a carrier, inert or active, making the composition especially suitable for diagnostic or therapeutic use in vivo or ex vivo.

As used herein, the term "pharmaceutically acceptable carrier" refers to any of the standard pharmaceutical carriers, such as a phosphate buffered saline solution, water, emulsions (e.g., such as an oil/water or water/oil emulsions), and various types of wetting agents. The compositions also can include stabilizers and preservatives. For examples of carriers, stabilizers and adjuvants, see e.g., Martin, Remington's Pharmaceutical Sciences, 15th Ed., Mack Publ. Co., Easton, PA (1975).

The terms "a" and "an" as used herein mean "one or more" and include the plural unless the context is inappropriate.

As used herein, all numerical values or numerical ranges include whole integers within or encompassing such ranges and fractions of the values or the integers within or encompassing ranges unless the context clearly indicates otherwise. Thus, for example, reference to a range of 90-100%, includes 91%, 92%, 93%, 94%, 95%, 95%, 96%, 97%, etc., as well as 91.1%, 91.2%, 91.3%, 91.4%, 91.5%, etc., 92.1%, 92.2%, 92.3%, 92.4%, 92.5%, etc., and so forth. In another example, reference to a range of 1-5,000-fold includes 1, 2, 3, 4, 5, 6, 7, 8, 9, 10, 11, 12, 13, 14, 15, 16, 17, 18, 19, 20, fold, etc., as well as 1.1, 1.2, 1.3, 1.4, 1.5, fold, etc., 2.1, 2.2, 2.3, 2.4, 2.5, fold, etc., and so forth.

"About" a number, as used herein, refers to range including the number and ranging from 10% below that number to 10% above that number. "About" a range refers to 10% below the lower limit of the range, spanning to 10% above the upper limit of the range.

"Percent (%) identity" refers to the extent to which two sequences (nucleotide or amino acid) have the same residue at the same positions in an alignment. For example, "an amino acid sequence is X % identical to SEQ ID NO: Y" refers to % identity of the amino acid sequence to SEQ ID NO: Y and is elaborated as X % of residues in the amino acid sequence are identical to the residues of sequence disclosed in SEQ ID NO: Y. Generally, computer programs are employed for such calculations. Exemplary programs that compare and align pairs of sequences include ALIGN (Myers and Miller, 1988), FASTA (Pearson and Lipman, 1988; Pearson, 1990) and gapped BLAST (Altschul et al., 1997), BLASTP, BLASTN, or GCG (Devereux et al., 1984).

Throughout the description, where compositions are described as having, including, or comprising specific components, or where processes and methods are described as having, including, or comprising specific steps, it is contemplated that, additionally, there are compositions of the present disclosure that consist essentially of, or consist of, the recited components, and that there are processes and methods according to the present disclosure that consist essentially of, or consist of, the recited processing steps.

As a general matter, compositions specifying a percentage are by weight unless otherwise specified. Further, if a variable is not accompanied by a definition, then the previous definition of the variable controls.

α4β7 Integrin Binding Proteins

Provided herein are α4β7 integrin binding proteins. In some embodiments, the α4β7 integrin binding protein is an antibody. In certain embodiments α4β7 integrin binding proteins comprise a modified Fc that extends half-life of the α4β7 binding protein as compared to an α4β7 binding protein that does not comprise the modified Fc.

Further described herein, in certain embodiments, are α4β7 integrin binding proteins, wherein the α4β7 binding protein specifically binds to an epitope of α4β7 and comprises a Fc domain comprising amino acid modifications M252Y, S254T, and T256E (YTE) and/or L234A/G237A (LAGA).

Amino acid sequences of exemplary CDRs of α4β7 integrin binding proteins are provided in Table 1.

TABLE 1

Sequences of CDRs

Kabat Numbering

| Antibody | CDRH1 | SEQ ID NO | CDRH2 | SEQ ID NO | CDRH3 | SEQ ID NO | CDRL1 | SEQ ID NO | CDRL2 | SEQ ID NO | CDRL3 | SEQ ID NO |
|---|---|---|---|---|---|---|---|---|---|---|---|---|
| Antibody 1 | SYWMH | 1 | EIDPSESNTNYNQKFKG | 107 | GGYDGWDYAIDY | 213 | RSSQSLAKSYGNTYLS | 319 | GISNRFS | 425 | LQGTHQPYT | 531 |
| Antibody 2 | SYWMH | 2 | EIDPSESNTNYNQKFKG | 108 | GGYDGWDYAIDY | 214 | RSSQSLAKSYGNTYLS | 320 | GISNRFS | 426 | LQGTHQPYT | 532 |
| Antibody 3 | IYWMH | 3 | EIDPSESNTNYNQKFKG | 109 | GGYDGWDYAIDY | 215 | RSSQSLAKSYGNTYLS | 321 | GISNRFS | 427 | LQGTHQPYT | 533 |
| Antibody 4 | VYWMH | 4 | EIDPSESNTNYNQKFKG | 110 | GGYDGWDYAIDY | 216 | RSSQSLAKSYGNTYLS | 322 | GISNRFS | 428 | LQGTHQPYT | 534 |
| Antibody 5 | SMWMH | 5 | EIDPSESNTNYNQKFKG | 111 | GGYDGWDYAIDY | 217 | RSSQSLAKSYGNTYLS | 323 | GISNRFS | 429 | LQGTHQPYT | 535 |
| Antibody 6 | SQWMH | 6 | EIDPSESNTNYNQKFKG | 112 | GGYDGWDYAIDY | 218 | RSSQSLAKSYGNTYLS | 324 | GISNRFS | 430 | LQGTHQPYT | 536 |
| Antibody 7 | SYWMH | 7 | EIIPSESNTNYNQKFKG | 113 | GGYDGWDYAIDY | 219 | RSSQSLAKSYGNTYLS | 325 | GISNRFS | 431 | LQGTHQPYT | 537 |
| Antibody 8 | SYWMH | 8 | EIIPLESNTNYNQKFKG | 114 | GGYDGWDYAIDY | 220 | RSSQSLAKSYGNTYLS | 326 | GISNRFS | 432 | LQGTHQPYT | 538 |
| Antibody 9 | SYWMH | 9 | EIIPRESNTNYNQKFKG | 115 | GGYDGWDYAIDY | 221 | RSSQSLAKSYGNTYLS | 327 | GISNRFS | 433 | LQGTHQPYT | 539 |
| Antibody 10 | SYWMH | 10 | EIIPVESNTNYNQKFKG | 116 | GGYDGWDYAIDY | 222 | RSSQSLAKSYGNTYLS | 328 | GISNRFS | 434 | LQGTHQPYT | 540 |
| Antibody 11 | SYWMH | 11 | EIRPSESNTNYNQKFKG | 117 | GGYDGWDYAIDY | 223 | RSSQSLAKSYGNTYLS | 329 | GISNRFS | 435 | LQGTHQPYT | 541 |

TABLE 1-continued

Sequences of CDRs

| | | | | | | | | | | | | |
|---|---|---|---|---|---|---|---|---|---|---|---|---|
| Antibody 12 | SYWMH | 12 | EIRPLES NTNYN QKFKG | 118 | GGYDG WDYAI DY | 224 | RSSQSL AKSYG NTYLS | 330 | GISNRF S | 436 | LQGTH QPYT | 542 |
| Antibody 13 | SYWMH | 13 | EIRPRES NTNYN QKFKG | 119 | GGYDG WDYAI DY | 225 | RSSQSL AKSYG NTYLS | 331 | GISNRF S | 437 | LQGTH QPYT | 543 |
| Antibody 14 | SYWMH | 14 | EIRPVES NTNYN QKFKG | 120 | GGYDG WDYAI DY | 226 | RSSQSL AKSYG NTYLS | 332 | GISNRF S | 438 | LQGTH QPYT | 544 |
| Antibody 15 | SYWMH | 15 | EIDPLES NTNYN QKFKG | 121 | GGYDG WDYAI DY | 227 | RSSQSL AKSYG NTYLS | 333 | GISNRF S | 439 | LQGTH QPYT | 545 |
| Antibody 16 | SYWMH | 16 | EIDPME SNTNYN QKFKG | 122 | GGYDG WDYAI DY | 228 | RSSQSL AKSYG NTYLS | 334 | GISNRF S | 440 | LQGTH QPYT | 546 |
| Antibody 17 | SYWMH | 17 | EIDPRES NTNYN QKFKG | 123 | GGYDG WDYAI DY | 229 | RSSQSL AKSYG NTYLS | 335 | GISNRF S | 441 | LQGTH QPYT | 547 |
| Antibody 18 | SYWMH | 18 | EIDPVE SNTNYN QKFKG | 124 | GGYDG WDYAI DY | 230 | RSSQSL AKSYG NTYLS | 336 | GISNRF S | 442 | LQGTH QPYT | 548 |
| Antibody 19 | SYWMH | 19 | EIDPSES NTNYN QKFKG | 125 | GGYDG WDYFID Y | 231 | RSSQSL AKSYG NTYLS | 337 | GISNRF S | 443 | LQGTH QPYT | 549 |
| Antibody 20 | SYWMH | 20 | EIDPSES NTNYN QKFKG | 126 | GGYDG WDYFIY Y | 232 | RSSQSL AKSYG NTYLS | 338 | GISNRF S | 444 | LQGTH QPYT | 550 |
| Antibody 21 | SYWMH | 21 | EIDPSES NTNYN QKFKG | 127 | GGYDG WDYLID Y | 233 | RSSQSL AKSYG NTYLS | 339 | GISNRF S | 445 | LQGTH QPYT | 551 |
| Antibody 22 | SYWMH | 22 | EIDPSES NTNYN QKFKG | 128 | GGYDG WDYVI DY | 234 | RSSQSL AKSYG NTYLS | 340 | GISNRF S | 446 | LQGTH QPYT | 552 |
| Antibody 23 | SYWMH | 23 | EIDPSES NTNYN QKFKG | 129 | GGYDG WDYVI YY | 235 | RSSQSL AKSYG NTYLS | 341 | GISNRF S | 447 | LQGTH QPYT | 553 |
| Antibody 24 | SYWMH | 24 | EIDPSES NTNYN QKFKG | 130 | GGYDG WDYWI DY | 236 | RSSQSL AKSYG NTYLS | 342 | GISNRF S | 448 | LQGTH QPYT | 554 |

TABLE 1-continued

Sequences of CDRs

| | | | | | | | | | | | |
|---|---|---|---|---|---|---|---|---|---|---|---|
| Antibody 25 | SYWMH | 25 | EIDPSESNTNYNQKFKG | 131 | GGYDGWDYYIDY | 237 | RSSQSLAKSYGNTYLS | 343 | GISNRFS | 449 | LQGTHQPYT | 555 |
| Antibody 26 | SYWMH | 26 | EIDPSESNTNYNQKFKG | 132 | GGYDGWDYYIYY | 238 | RSSQSLAKSYGNTYLS | 344 | GISNRFS | 450 | LQGTHQPYT | 556 |
| Antibody 27 | SYWMH | 27 | EIDPSESNTNYNQKFKG | 133 | GGYDGWDYAIDY | 239 | RSSQSLAKSYGNTYLS | 345 | GISNRFS | 451 | LQGTHQPYT | 557 |
| Antibody 28 | SYWMH | 28 | EIDPSESNTNYNQKFKG | 134 | GGYDGWDYAIDY | 240 | RSSQSLAKSYGNTYLS | 346 | GISNRFS | 452 | LQGTHQPYT | 558 |
| Antibody 29 | SYWMH | 29 | EIDPSESNTNYNQKFKG | 135 | GGYDGWDYAIDY | 241 | RSSQSLAKSYGNTYLS | 347 | GISNRFS | 453 | LQGTHQPYT | 559 |
| Antibody 30 | SYWMH | 30 | EIDPSESNTNYNQKFKG | 136 | GGYDGWDYAIDY | 242 | RSSQSLAKSYGNTYLS | 348 | GISNRFS | 454 | LQGTHQPYT | 560 |
| Antibody 31 | SYWMH | 31 | EIDPSESNTNYNQKFKG | 137 | GGYDGWDYAIDY | 243 | RSSQSLAKSYGNTYLS | 349 | GISNRFS | 455 | LQGTHQPYT | 561 |
| Antibody 32 | SYWMH | 32 | EIDPSESNTNYNQKFKG | 138 | GGYWGWDYAIDY | 244 | RSSQSLAKSYGNTYLS | 350 | GISNRFS | 456 | LQGTHQPYT | 562 |
| Antibody 33 | SYWMH | 33 | EIDPSESNTNYNQKFKG | 139 | GGYYGWDYAIDY | 245 | RSSQSLAKSYGNTYLS | 351 | GISNRFS | 457 | LQGTHQPYT | 563 |
| Antibody 34 | SYWMH | 34 | EIDPSESNTNYNQKFKG | 140 | GGYDGWDYAIFY | 246 | RSSQSLAKSYGNTYLS | 352 | GISNRFS | 458 | LQGTHQPYT | 564 |
| Antibody 35 | SYWMH | 35 | EIDPSESNTNYNQKFKG | 141 | GGYDGWDYAIMY | 247 | RSSQSLAKSYGNTYLS | 353 | GISNRFS | 459 | LQGTHQPYT | 565 |
| Antibody 36 | SYWMH | 36 | EIDPSESNTNYNQKFKG | 142 | GGYDGWDYAIWY | 248 | RSSQSLAKSYGNTYLS | 354 | GISNRFS | 460 | LQGTHQPYT | 566 |

TABLE 1-continued

Sequences of CDRs

| Antibody | | SEQ | | SEQ | | SEQ | | SEQ | | SEQ | | SEQ |
|---|---|---|---|---|---|---|---|---|---|---|---|---|
| Antibody 37 | SYWMH | 37 | EIDPSES NTNYN QKFKG | 143 | GGYDG WDYAI YY | 249 | RSSQSL AKSYG NTYLS | 355 | GISNRF S | 461 | LQGTH QPYT | 567 |
| Antibody 38 | SYWMH | 38 | EIDPSES NTNYN QKFKG | 144 | GFYDG WDYAI DY | 250 | RSSQSL AKSYG NTYLS | 356 | GISNRF S | 462 | LQGTH QPYT | 568 |
| Antibody 39 | SYWMH | 39 | EIDPSES NTNYN QKFKG | 145 | GFYDG WDYLID Y | 251 | RSSQSL AKSYG NTYLS | 357 | GISNRF S | 463 | LQGTH QPYT | 569 |
| Antibody 40 | SYWMH | 40 | EIDPSES NTNYN QKFKG | 146 | GFYDG WDYAI YY | 252 | RSSQSL AKSYG NTYLS | 358 | GISNRF S | 464 | LQGTH QPYT | 570 |
| Antibody 41 | SYWMH | 41 | EIDPSES NTNYN QKFKG | 147 | GMYDG WDYAI DY | 253 | RSSQSL AKSYG NTYLS | 359 | GISNRF S | 465 | LQGTH QPYT | 571 |
| Antibody 42 | SYWMH | 42 | EIDPSES NTNYN QKFKG | 148 | GRYDG WDYAI DY | 254 | RSSQSL AKSYG NTYLS | 360 | GISNRF S | 466 | LQGTH QPYT | 572 |
| Antibody 43 | SYWMH | 43 | EIDPSES NTNYN QKFKG | 149 | GVVDG WDYAI DY | 255 | RSSQSL AKSYG NTYLS | 361 | GISNRF S | 467 | LQGTH QPYT | 573 |
| Antibody 44 | SYWMH | 44 | EIDPSES NTNYN QKFKG | 150 | GGYDI WDYAI DY | 256 | RSSQSL AKSYG NTYLS | 362 | GISNRF S | 468 | LQGTH QPYT | 574 |
| Antibody 45 | SYWMH | 45 | EIDPSES NTNYN QKFKG | 151 | GGYDL WDYAI DY | 257 | RSSQSL AKSYG NTYLS | 363 | GISNRF S | 469 | LQGTH QPYT | 575 |
| Antibody 46 | SYWMH | 46 | EIDPSES NTNYN QKFKG | 152 | GGYDV WDYAI DY | 258 | RSSQSL AKSYG NTYLS | 364 | GISNRF S | 470 | LQGTH QPYT | 576 |
| Antibody 47 | SYWMH | 47 | EIDPSES NTNYN QKFKG | 153 | FGYDG WDYAI DY | 259 | RSSQSL AKSYG NTYLS | 365 | GISNRF S | 471 | LQGTH QPYT | 577 |
| Antibody 48 | SYWMH | 48 | EIDPSES NTNYN QKFKG | 154 | YGYDG WDYAI DY | 260 | RSSQSL AKSYG NTYLS | 366 | GISNRF S | 472 | LQGTH QPYT | 578 |

TABLE 1-continued

Sequences of CDRs

| Antibody | | | | | | | | | | | | |
|---|---|---|---|---|---|---|---|---|---|---|---|---|
| Antibody 49 | SYWMH | 49 | EIDPSES NTNYN QKFKG | 155 | GGYDG WDYAI DY | 261 | RSSQSL AASYG NTYLS | 367 | GISNRF S | 473 | LQGTH QPYT | 579 |
| Antibody 50 | SYWMH | 50 | EIDPSES NTNYN QKFKG | 156 | GGYDG WDYAI DY | 262 | RSSQSL ADSYG NTYLS | 368 | GISNRF S | 474 | LQGTH QPYT | 580 |
| Antibody 51 | SYWMH | 51 | EIDPSES NTNYN QKFKG | 157 | GGYDG WDYAI DY | 263 | RSSQSL AISYGN TYLS | 369 | GISNRF S | 475 | LQGTH QPYT | 581 |
| Antibody 52 | SYWMH | 52 | EIDPSES NTNYN QKFKG | 158 | GGYDG WDYAI DY | 264 | RSSQSL AIFYGN TYLS | 370 | GISNRF S | 476 | LQGTH QPYT | 582 |
| Antibody 53 | SYWMH | 53 | EIDPSES NTNYN QKFKG | 159 | GGYDG WDYAI DY | 265 | RSSQSL AIFYGIT YLS | 371 | GISNRF S | 477 | LQGTH QPYT | 583 |
| Antibody 54 | SYWMH | 54 | EIDPSES NTNYN QKFKG | 160 | GGYDG WDYAI DY | 266 | RSSQSL AIFYGL TYLS | 372 | GISNRF S | 478 | LQGTH QPYT | 584 |
| Antibody 55 | SYWMH | 55 | EIDPSES NTNYN QKFKG | 161 | GGYDG WDYAI DY | 267 | RSSQSL AILYGIT YLS | 373 | GISNRF S | 479 | LQGTH QPYT | 585 |
| Antibody 56 | SYWMH | 56 | EIDPSES NTNYN QKFKG | 162 | GGYDG WDYAI DY | 268 | RSSQSL AILYGL TYLS | 374 | GISNRF S | 480 | LQGTH QPYT | 586 |
| Antibody 57 | SYWMH | 57 | EIDPSES NTNYN QKFKG | 163 | GGYDG WDYAI DY | 269 | RSSQSL ALSYGN TYLS | 375 | GISNRF S | 481 | LQGTH QPYT | 587 |
| Antibody 58 | SYWMH | 58 | EIDPSES NTNYN QKFKG | 164 | GGYDG WDYAI DY | 270 | RSSQSL AMSYG NTYLS | 376 | GISNRF S | 482 | LQGTH QPYT | 588 |
| Antibody 59 | SYWMH | 59 | EIDPSES NTNYN QKFKG | 165 | GGYDG WDYAI DY | 271 | RSSQSL ANSYG NTYLS | 377 | GISNRF S | 483 | LQGTH QPYT | 589 |
| Antibody 60 | SYWMH | 60 | EIDPSES NTNYN QKFKG | 166 | GGYDG WDYAI DY | 272 | RSSQSL APSYGN TYLS | 378 | GISNRF S | 484 | LQGTH QPYT | 590 |

TABLE 1-continued

Sequences of CDRs

| Antibody 61 | SYWMH | 61 | EIDPSES NTNYN QKFKG | 167 | GGYDG WDYAI DY | 273 | RSSQSL AQSYG NTYLS | 379 | GISNRF S | 485 | LQGTH QPYT | 591 |
|---|---|---|---|---|---|---|---|---|---|---|---|---|
| Antibody 62 | SYWMH | 62 | EIDPSES NTNYN QKFKG | 168 | GGYDG WDYAI DY | 274 | RSSQSL ARSYG NTYLS | 380 | GISNRF S | 486 | LQGTH QPYT | 592 |
| Antibody 63 | SYWMH | 63 | EIDPSES NTNYN QKFKG | 169 | GGYDG WDYAI DY | 275 | RSSQSL ARFYGL TYLS | 381 | GISNRF S | 487 | LQGTH QPYT | 593 |
| Antibody 64 | SYWMH | 64 | EIDPSES NTNYN QKFKG | 170 | GGYDG WDYAI DY | 276 | RSSQSL ASSYGN TYLS | 382 | GISNRF S | 488 | LQGTH QPYT | 594 |
| Antibody 65 | SYWMH | 65 | EIDPSES NTNYN QKFKG | 171 | GGYDG WDYAI DY | 277 | RSSQSL ATSYGN TYLS | 383 | GISNRF S | 489 | LQGTH QPYT | 595 |
| Antibody 66 | SYWMH | 66 | EIDPSES NTNYN QKFKG | 172 | GGYDG WDYAI DY | 278 | RSSQSL ATYYGI TYLS | 384 | GISNRF S | 490 | LQGTH QPYT | 596 |
| Antibody 67 | SYWMH | 67 | EIDPSES NTNYN QKFKG | 173 | GGYDG WDYAI DY | 279 | RSSQSL ATYYG LTYLS | 385 | GISNRF S | 491 | LQGTH QPYT | 597 |
| Antibody 68 | SYWMH | 68 | EIDPSES NTNYN QKFKG | 174 | GGYDG WDYAI DY | 280 | RSSQSL AVSYG NTYLS | 386 | GISNRF S | 492 | LQGTH QPYT | 598 |
| Antibody 69 | SYWMH | 69 | EIDPSES NTNYN QKFKG | 175 | GGYDG WDYAI DY | 281 | RSSQSL AVSYG NTYLS | 387 | GISNRF S | 493 | LQGTH QPYT | 599 |
| Antibody 70 | SYWMH | 70 | EIDPSES NTNYN QKFKG | 176 | GGYDG WDYAI DY | 282 | RSSQSL AYFYGI TYLS | 388 | GISNRF S | 494 | LQGTH QPYT | 600 |
| Antibody 71 | SYWMH | 71 | EIDPSES NTNYN QKFKG | 177 | GGYDG WDYAI DY | 283 | RSSQSL AYLYGI TYLS | 389 | GISNRF S | 495 | LQGTH QPYT | 601 |
| Antibody 72 | SYWMH | 72 | EIDPSES NTNYN QKFKG | 178 | GGYDG WDYAI DY | 284 | RSSQSL AKSYGI TYLS | 390 | GISNRF S | 496 | LQGTH QPYT | 602 |

TABLE 1-continued

Sequences of CDRs

| Antibody | | | | | | | | | | | |
|---|---|---|---|---|---|---|---|---|---|---|---|
| Antibody 73 | SYWMH | 179 | EIDPSES NTNYN QKFKG | 285 | GGYDG WDYAI DY | 391 | RSSQSL AKSYGL TYLS | 497 | GISNRF S | 603 | LQGTH QPYT |
| Antibody 74 | SYWMH | 180 | EIDPSES NTNYN QKFKG | 286 | GGYDG WDYAI DY | 392 | RSSQSL AKFYG NTYLS | 498 | GISNRF S | 604 | LQGTH QPYT |
| Antibody 75 | SYWMH | 181 | EIDPSES NTNYN QKFKG | 287 | GGYDG WDYAI DY | 393 | RSSQSL AKIYGN TYLS | 499 | GISNRF S | 605 | LQGTH QPYT |
| Antibody 76 | SYWMH | 182 | EIDPSES NTNYN QKFKG | 288 | GGYDG WDYAI DY | 394 | RSSQSL AKLYG NTYLS | 500 | GISNRF S | 606 | LQGTH QPYT |
| Antibody 77 | SYWMH | 183 | EIDPSES NTNYN QKFKG | 289 | GGYDG WDYAI DY | 395 | RSSQSL AKMYG NTYLS | 501 | GISNRF S | 607 | LQGTH QPYT |
| Antibody 78 | SYWMH | 184 | EIDPSES NTNYN QKFKG | 290 | GGYDG WDYAI DY | 396 | RSSQSL AKQYG NTYLS | 502 | GISNRF S | 608 | LQGTH QPYT |
| Antibody 79 | SYWMH | 185 | EIDPSES NTNYN QKFKG | 291 | GGYDG WDYAI DY | 397 | RSSQSL AKYYG NTYLS | 503 | GISNRF S | 609 | LQGTH QPYT |
| Antibody 80 | SYWMH | 186 | EIDPSES NTNYN QKFKG | 292 | GGYDG WDYAI DY | 398 | RSSQSL AKSHG NTYLS | 504 | GISNRF S | 610 | LQGTH QPYT |
| Antibody 81 | SYWMH | 187 | EIDPSES NTNYN QKFKG | 293 | GGYDG WDYAI DY | 399 | RSSQSL AKSYG NTYLS | 505 | FISNRFS | 611 | LQGTH QPYT |
| Antibody 82 | SYWMH | 188 | EIDPSES NTNYN QKFKG | 294 | GGYDG WDYAI DY | 400 | RSSQSL AKSYG NTYLS | 506 | PISNRFS | 612 | LQGTH QPYT |
| Antibody 83 | SYWMH | 189 | EIDPSES NTNYN QKFKG | 295 | GGYDG WDYAI DY | 401 | RSSQSL AKSYG NTYLS | 507 | YISNRF S | 613 | LQGTH QPYT |
| Antibody 84 | SYWMH | 190 | EIDPSES NTNYN QKFKG | 296 | GGYDG WDYAI DY | 402 | RSSQSL AKSYG NTYLS | 508 | GISNRF S | 614 | LQFTHQ PYT |

TABLE 1-continued

Sequences of CDRs

| Antibody 85 | SYWMH | 85 | EIDPSES NTNYN QKFKG | 191 | GGYDG WDYAI DY | 297 | RSSQSL AKSYG NTYLS | 403 | GISNRF S | 509 | LQFTIQ FYT | 615 |
| Antibody 86 | SYWMH | 86 | EIDPSES NTNYN QKFKG | 192 | GGYDG WDYAI DY | 298 | RSSQSL AKSYG NTYLS | 404 | GISNRF S | 510 | LQFTIQ VYT | 616 |
| Antibody 87 | SYWMH | 87 | EIDPSES NTNYN QKFKG | 193 | GGYDG WDYAI DY | 299 | RSSQSL AKSYG NTYLS | 405 | GISNRF S | 511 | LQFTIQ PYI | 617 |
| Antibody 88 | SYWMH | 88 | EIDPSES NTNYN QKFKG | 194 | GGYDG WDYAI DY | 300 | RSSQSL AKSYG NTYLS | 406 | GISNRF S | 512 | LQFTHQ FYT | 618 |
| Antibody 89 | SYWMH | 89 | EIDPSES NTNYN QKFKG | 195 | GGYDG WDYAI DY | 301 | RSSQSL AKSYG NTYLS | 407 | GISNRF S | 513 | LQFTHQ IYI | 619 |
| Antibody 90 | SYWMH | 90 | EIDPSES NTNYN QKFKG | 196 | GGYDG WDYAI DY | 302 | RSSQSL AKSYG NTYLS | 408 | GISNRF S | 514 | LQFTHQ PYI | 620 |
| Antibody 91 | SYWMH | 91 | EIDPSES NTNYN QKFKG | 197 | GGYDG WDYAI DY | 303 | RSSQSL AKSYG NTYLS | 409 | GISNRF S | 515 | LQRTIQ PYT | 621 |
| Antibody 92 | SYWMH | 92 | EIDPSES NTNYN QKFKG | 198 | GGYDG WDYAI DY | 304 | RSSQSL AKSYG NTYLS | 410 | GISNRF S | 516 | LQRTIQ VYI | 622 |
| Antibody 93 | SYWMH | 93 | EIDPSES NTNYN QKFKG | 199 | GGYDG WDYAI DY | 305 | RSSQSL AKSYG NTYLS | 411 | GISNRF S | 517 | LQRTIQ YYT | 623 |
| Antibody 94 | SYWMH | 94 | EIDPSES NTNYN QKFKG | 200 | GGYDG WDYAI DY | 306 | RSSQSL AKSYG NTYLS | 412 | GISNRF S | 518 | LQVTH QPYT | 624 |
| Antibody 95 | SYWMH | 95 | EIDPSES NTNYN QKFKG | 201 | GGYDG WDYAI DY | 307 | RSSQSL AKSYG NTYLS | 413 | GISNRF S | 519 | LQWTH QPYT | 625 |
| Antibody 96 | SYWMH | 96 | EIDPSES NTNYN QKFKG | 202 | GGYDG WDYAI DY | 308 | RSSQSL AKSYG NTYLS | 414 | GISNRF S | 520 | LQVTH QPYT | 626 |

TABLE 1-continued

Sequences of CDRs

| Antibody | | | | | | | | | | | | |
|---|---|---|---|---|---|---|---|---|---|---|---|---|
| Antibody 97 | SYWMH | 97 | EIDPSESNTNYNQKFKG | 203 | GGYDGWDYAIDY | 309 | RSSQSLAKSYGNTYLS | 415 | GISNRFS | 521 | LQQTIQFYI | 627 |
| Antibody 98 | SYWMH | 98 | EIDPSESNTNYNQKFKG | 204 | GGYDGWDYAIDY | 310 | RSSQSLAKSYGNTYLS | 416 | GISNRFS | 522 | LQQTHQFYI | 628 |
| Antibody 99 | SYWMH | 99 | EIDPSESNTNYNQKFKG | 205 | GGYDGWDYAIDY | 311 | RSSQSLAKSYGNTYLS | 417 | GISNRFS | 523 | LQQTIQPYT | 629 |
| Antibody 100 | SYWMH | 100 | EIDPSESNTNYNQKFKG | 206 | GGYDGWDYAIDY | 312 | RSSQSLAKSYGNTYLS | 418 | GISNRFS | 524 | LQQTWQPYT | 630 |
| Antibody 101 | SYWMH | 101 | EIDPSESNTNYNQKFKG | 207 | GGYDGWDYAIDY | 313 | RSSQSLAKSYGNTYLS | 419 | GISNRFS | 525 | LQQTHQFYT | 631 |
| Antibody 102 | SYWMH | 102 | EIDPSESNTNYNQKFKG | 208 | GGYDGWDYAIDY | 314 | RSSQSLAKSYGNTYLS | 420 | GISNRFS | 526 | LQQTHQIYT | 632 |
| Antibody 103 | SYWMH | 103 | EIDPSESNTNYNQKFKG | 209 | GGYDGWDYAIDY | 315 | RSSQSLAKSYGNTYLS | 421 | GISNRFS | 527 | LQQTHQVYT | 633 |
| Antibody 104 | SYWMH | 104 | EIDPSESNTNYNQKFKG | 210 | GGYDGWDYAIDY | 316 | RSSQSLAKSYGNTYLS | 422 | GISNRFS | 528 | LQQTHQYYT | 634 |
| Antibody 105 | SYWMH | 105 | EIDPSESNTNYNQKFKG | 211 | GGYDGWDYAIDY | 317 | RSSQSLAKSYGNTYLS | 423 | GISNRFS | 529 | LQQTHQPYI | 635 |
| Antibody 106 | SYWMH | 106 | EIDPSESNTNYNQKFKG | 212 | GGYDGWDYAIDY | 318 | RSSQSLAKSYGNTYLS | 424 | GISNRFS | 530 | LQQTHQPYR | 636 |

Chothia Numbering

| Antibody | | | | | | | | | | | | |
|---|---|---|---|---|---|---|---|---|---|---|---|---|
| Antibody 1 | GGTFTSYWMH | 637 | DPSESN | 743 | GGYDGWDYAIDY | 849 | RSSQSLAKSYGNTYLS | 955 | GISNRFS | 1061 | LQQTHQPYT | 1167 |
| Antibody 2 | GYTFTSYWMH | 638 | DPSESN | 744 | GGYDGWDYAIDY | 850 | RSSQSLAKSYGNTYLS | 956 | GISNRFS | 1062 | LQQTHQPYT | 1168 |

TABLE 1-continued

Sequences of CDRs

| Antibody | | | | | | | | | | | | |
|---|---|---|---|---|---|---|---|---|---|---|---|---|
| Antibody 3 | 639 | GYTFTI YWMH | 745 | DPSESN | 851 | GGGVDG WDYAI DY | 957 | RSSQSL AKSYG NTYLS | 1063 | GISNRF S | 1169 | LQGTH QPYT |
| Antibody 4 | 640 | GYTFTV YWMH | 746 | DPSESN | 852 | GGGVDG WDYAI DY | 958 | RSSQSL AKSYG NTYLS | 1064 | GISNRF S | 1170 | LQGTH QPYT |
| Antibody 5 | 641 | GYTFTS MWMH | 747 | DPSESN | 853 | GGGVDG WDYAI DY | 959 | RSSQSL AKSYG NTYLS | 1065 | GISNRF S | 1171 | LQGTH QPYT |
| Antibody 6 | 642 | GYTFTS QWMH | 748 | DPSESN | 854 | GGGVDG WDYAI DY | 960 | RSSQSL AKSYG NTYLS | 1066 | GISNRF S | 1172 | LQGTH QPYT |
| Antibody 7 | 643 | GYTFTS YWMH | 749 | IPSESN | 855 | GGGVDG WDYAI DY | 961 | RSSQSL AKSYG NTYLS | 1067 | GISNRF S | 1173 | LQGTH QPYT |
| Antibody 8 | 644 | GYTFTS YWMH | 750 | IPLESN | 856 | GGGVDG WDYAI DY | 962 | RSSQSL AKSYG NTYLS | 1068 | GISNRF S | 1174 | LQGTH QPYT |
| Antibody 9 | 645 | GYTFTS YWMH | 751 | IPRESN | 857 | GGGVDG WDYAI DY | 963 | RSSQSL AKSYG NTYLS | 1069 | GISNRF S | 1175 | LQGTH QPYT |
| Antibody 10 | 646 | GYTFTS YWMH | 752 | IPVESN | 858 | GGGVDG WDYAI DY | 964 | RSSQSL AKSYG NTYLS | 1070 | GISNRF S | 1176 | LQGTH QPYT |
| Antibody 11 | 647 | GYTFTS YWMH | 753 | RPSESN | 859 | GGGVDG WDYAI DY | 965 | RSSQSL AKSYG NTYLS | 1071 | GISNRF S | 1177 | LQGTH QPYT |
| Antibody 12 | 648 | GYTFTS YWMH | 754 | RPLESN | 860 | GGGVDG WDYAI DY | 966 | RSSQSL AKSYG NTYLS | 1072 | GISNRF S | 1178 | LOGTH QPYT |
| Antibody 13 | 649 | GYTFTS YWMH | 755 | RPRESN | 861 | GGGVDG WDYAI DY | 967 | RSSQSL AKSYG NTYLS | 1073 | GISNRF S | 1179 | LQGTH QPYT |
| Antibody 14 | 650 | GYTFTS YWMH | 756 | RPVESN | 862 | GGGVDG WDYAI DY | 968 | RSSQSL AKSYG NTYLS | 1074 | GISNRF S | 1180 | LQGTH QPYT |
| Antibody 15 | 651 | GYTFTS YWMH | 757 | DPLESN | 863 | GGGVDG WDYAI DY | 969 | RSSQSL AKSYG NTYLS | 1075 | GISNRF S | 1181 | LQGTH QPYT |

TABLE 1-continued

Sequences of CDRs

| | | | | | | | | | | | | |
|---|---|---|---|---|---|---|---|---|---|---|---|---|
| Antibody 16 | 652 | GYTFTS YWMH | 758 | DPMESN | 864 | GGYDG WDYAI DY | 970 | RSSQSL AKSYG NTYLS | 1076 | GISNRF S | 1182 | LQGTH QPYT |
| Antibody 17 | 653 | GYTFTS YWMH | 759 | DPRESN | 865 | GGYDG WDYAI DY | 971 | RSSQSL AKSYG NTYLS | 1077 | GISNRF S | 1183 | LQGTH QPYT |
| Antibody 18 | 654 | GYTFTS YWMH | 760 | DPVESN | 866 | GGYDG WDYAI DY | 972 | RSSQSL AKSYG NTYLS | 1078 | GISNRF S | 1184 | LQGTH QPYT |
| Antibody 19 | 655 | GYTFTS YWMH | 761 | DPSESN | 867 | GGYDG WDYFID Y | 973 | RSSQSL AKSYG NTYLS | 1079 | GISNRF S | 1185 | LQGTH QPYT |
| Antibody 20 | 656 | GYTFTS YWMH | 762 | DPSESN | 868 | GGYDG WDYFIY Y | 974 | RSSQSL AKSYG NTYLS | 1080 | GISNRF S | 1186 | LQGTH QPYT |
| Antibody 21 | 657 | GYTFTS YWMH | 763 | DPSESN | 869 | GGYDG WDYLID Y | 975 | RSSQSL AKSYG NTYLS | 1081 | GISNRF S | 1187 | LQGTH QPYT |
| Antibody 22 | 658 | GYTFTS YWMH | 764 | DPSESN | 870 | GGYDG WDYVI DY | 976 | RSSQSL AKSYG NTYLS | 1082 | GISNRF S | 1188 | LQGTH QPYT |
| Antibody 23 | 659 | GYTFTS YWMH | 765 | DPSESN | 871 | GGYDG WDYVI YY | 977 | RSSQSL AKSYG NTYLS | 1083 | GISNRF S | 1189 | LQGTH QPYT |
| Antibody 24 | 660 | GYTFTS YWMH | 766 | DPSESN | 872 | GGYDG WDYWI DY | 978 | RSSQSL AKSYG NTYLS | 1084 | GISNRF S | 1190 | LQGTH QPYT |
| Antibody 25 | 661 | GYTFTS YWMH | 767 | DPSESN | 873 | GGYDG WDYYI DY | 979 | RSSQSL AKSYG NTYLS | 1085 | GISNRF S | 1191 | LQGTH QPYT |
| Antibody 26 | 662 | GYTFTS YWMH | 768 | DPSESN | 874 | GGYDG WDYYI YY | 980 | RSSQSL AKSYG NTYLS | 1086 | GISNRF S | 1192 | LQGTH QPYT |
| Antibody 27 | 663 | GYTFTS YWMH | 769 | DPSESN | 875 | GGYDG WDYAI DY | 981 | RSSQSL AKSYG NTYLS | 1087 | GISNRF S | 1193 | LQGTH QPYT |

TABLE 1-continued

Sequences of CDRs

| Antibody | | | | | | | | | | | | |
|---|---|---|---|---|---|---|---|---|---|---|---|---|
| Antibody 28 | 664 | GYTFTS YWMH | 770 | DPSESN | 876 | GGYDG WDYAI DY | 982 | RSSQSL AKSYG NTYLS | 1088 | GISNRF S | 1194 | LQGTH QPYT |
| Antibody 29 | 665 | GYTFTS YWMH | 771 | DPSESN | 877 | GGYDG WDYAI DY | 983 | RSSQSL AKSYG NTYLS | 1089 | GISNRF S | 1195 | LQGTH QPYT |
| Antibody 30 | 666 | GYTFTS YWMH | 772 | DPSESN | 878 | GGYDG WDYAI DY | 984 | RSSQSL AKSYG NTYLS | 1090 | GISNRF S | 1196 | LQGTH QPYT |
| Antibody 31 | 667 | GYTFTS YWMH | 773 | DPSESN | 879 | GGYDG WDYAI DY | 985 | RSSQSL AKSYG NTYLS | 1091 | GISNRF S | 1197 | LQGTH QPYT |
| Antibody 32 | 668 | GYTFTS YWMH | 774 | DPSESN | 880 | GGYWG WDYAI DY | 986 | RSSQSL AKSYG NTYLS | 1092 | GISNRF S | 1198 | LQGTH QPYT |
| Antibody 33 | 669 | GYTFTS YWMH | 775 | DPSESN | 881 | GGYYG WDYAI DY | 987 | RSSQSL AKSYG NTYLS | 1093 | GISNRF S | 1199 | LQGTH QPYT |
| Antibody 34 | 670 | GYTFTS YWMH | 776 | DPSESN | 882 | GGYDG WDYAIF Y | 988 | RSSQSL AKSYG NTYLS | 1094 | GISNRF S | 1200 | LQGTH QPYT |
| Antibody 35 | 671 | GYTFTS YWMH | 777 | DPSESN | 883 | GGYDG WDYAI MY | 989 | RSSQSL AKSYG NTYLS | 1095 | GISNRF S | 1201 | LQGTH QPYT |
| Antibody 36 | 672 | GYTFTS YWMH | 778 | DPSESN | 884 | GGYDG WDYAI WY | 990 | RSSQSL AKSYG NTYLS | 1096 | GISNRF S | 1202 | LQGTH QPYT |
| Antibody 37 | 673 | GYTFTS YWMH | 779 | DPSESN | 885 | GGYDG WDYAI YY | 991 | RSSQSL AKSYG NTYLS | 1097 | GISNRF S | 1203 | LQGTH QPYT |
| Antibody 38 | 674 | GYTFTS YWMH | 780 | DPSESN | 886 | GFYDG WDYAI DY | 992 | RSSQSL AKSYG NTYLS | 1098 | GISNRF S | 1204 | LQGTH QPYT |
| Antibody 39 | 675 | GYTFTS YWMH | 781 | DPSESN | 887 | GFYDG WDYLID Y | 993 | RSSQSL AKSYG NTYLS | 1099 | GISNRF S | 1205 | LQGTH QPYT |

TABLE 1-continued

Sequences of CDRs

| | | | | | | | | | | | |
|---|---|---|---|---|---|---|---|---|---|---|---|
| Antibody 40 | GYTFTS YWMH | 676 | DPSESN | 782 | GFYDG WDYAI YY | 888 | RSSQSL AKSYG NTYLS | 994 | GISNRF S | 1100 | LQGTH QPYT | 1206 |
| Antibody 41 | GYTFTS YWMH | 677 | DPSESN | 783 | GMVDG WDYAI DY | 889 | RSSQSL AKSYG NTYLS | 995 | GISNRF S | 1101 | LQGTH QPYT | 1207 |
| Antibody 42 | GYTFTS YWMH | 678 | DPSESN | 784 | GRYDG WDYAI DY | 890 | RSSQSL AKSYG NTYLS | 996 | GISNRF S | 1102 | LQGTH QPYT | 1208 |
| Antibody 43 | GYTFTS YWMH | 679 | DPSESN | 785 | GVVDG WDYAI DY | 891 | RSSQSL AKSYG NTYLS | 997 | GISNRF S | 1103 | LQGTH QPYT | 1209 |
| Antibody 44 | GYTFTS YWMH | 680 | DPSESN | 786 | GGYDI WDYAI DY | 892 | RSSQSL AKSYG NTYLS | 998 | GISNRF S | 1104 | LQGTH QPYT | 1210 |
| Antibody 45 | GYTFTS YWMH | 681 | DPSESN | 787 | GGYDL WDYAI DY | 893 | RSSQSL AKSYG NTYLS | 999 | GISNRF S | 1105 | LQGTH QPYT | 1211 |
| Antibody 46 | GYTFTS YWMH | 682 | DPSESN | 788 | GGYDV WDYAI DY | 894 | RSSQSL AKSYG NTYLS | 1000 | GISNRF S | 1106 | LQGTH QPYT | 1212 |
| Antibody 47 | GYTFTS YWMH | 683 | DPSESN | 789 | FGYDG WDYAI DY | 895 | RSSQSL AKSYG NTYLS | 1001 | GISNRF S | 1107 | LQGTH QPYT | 1213 |
| Antibody 48 | GYTFTS YWMH | 684 | DPSESN | 790 | YGYDG WDYAI DY | 896 | RSSQSL AKSYG NTYLS | 1002 | GISNRF S | 1108 | LQGTH QPYT | 1214 |
| Antibody 49 | GYTFTS YWMH | 685 | DPSESN | 791 | GGYDG WDYAI DY | 897 | RSSQSL AASYG NTYLS | 1003 | GISNRF S | 1109 | LQGTH QPYT | 1215 |
| Antibody 50 | GYTFTS YWMH | 686 | DPSESN | 792 | GGYDG WDYAI DY | 898 | RSSQSL ADSYG NTYLS | 1004 | GISNRF S | 1110 | LQGTH QPYT | 1216 |
| Antibody 51 | GYTFTS YWMH | 687 | DPSESN | 793 | GGYDG WDYAI DY | 899 | RSSQSL AISYGN TYLS | 1005 | GISNRF S | 1111 | LQGTH QPYT | 1217 |

TABLE 1-continued

Sequences of CDRs

| Antibody | | | | | | | | | | | |
|---|---|---|---|---|---|---|---|---|---|---|---|
| Antibody 52 | 688 | GYTFTS YWMH | 794 | DPSESN | 900 | GGYDG WDYAI DY | 1006 | RSSQSL AIFYGN TYLS | 1112 | GISNRF S | 1218 | LQGTH QPYT |
| Antibody 53 | 689 | GYTFTS YWMH | 795 | DPSESN | 901 | GGYDG WDYAI DY | 1007 | RSSQSL AIFYGIT YLS | 1113 | GISNRF S | 1219 | LQGTH QPYT |
| Antibody 54 | 690 | GYTFTS YWMH | 796 | DPSESN | 902 | GGYDG WDYAI DY | 1008 | RSSQSL AIFYGL TYLS | 1114 | GISNRF S | 1220 | LQGTH QPYT |
| Antibody 55 | 691 | GYTFTS YWMH | 797 | DPSESN | 903 | GGYDG WDYAI DY | 1009 | RSSQSL AILYGIT YLS | 1115 | GISNRF S | 1221 | LQGTH QPYT |
| Antibody 56 | 692 | GYTFTS YWMH | 798 | DPSESN | 904 | GGYDG WDYAI DY | 1010 | RSSQSL AILYGL TYLS | 1116 | GISNRF S | 1222 | LQGTH QPYT |
| Antibody 57 | 693 | GYTFTS YWMH | 799 | DPSESN | 905 | GGYDG WDYAI DY | 1011 | RSSQSL ALSYGN TYLS | 1117 | GISNRF S | 1223 | LQGTH QPYT |
| Antibody 58 | 694 | GYTFTS YWMH | 800 | DPSESN | 906 | GGYDG WDYAI DY | 1012 | RSSQSL AMSYG NTYLS | 1118 | GISNRF S | 1224 | LQGTH QPYT |
| Antibody 59 | 695 | GYTFTS YWMH | 801 | DPSESN | 907 | GGYDG WDYAI DY | 1013 | RSSQSL ANSYG NTYLS | 1119 | GISNRF S | 1225 | LQGTH QPYT |
| Antibody 60 | 696 | GYTFTS YWMH | 802 | DPSESN | 908 | GGYDG WDYAI DY | 1014 | RSSQSL APSYGN TYLS | 1120 | GISNRF S | 1226 | LQGTH QPYT |
| Antibody 61 | 697 | GYTFTS YWMH | 803 | DPSESN | 909 | GGYDG WDYAI DY | 1015 | RSSQSL AQSYG NTYLS | 1121 | GISNRF S | 1227 | LQGTH QPYT |
| Antibody 62 | 698 | GYTFTS YWMH | 804 | DPSESN | 910 | GGYDG WDYAI DY | 1016 | RSSQSL ARSYG NTYLS | 1122 | GISNRF S | 1228 | LQGTH QPYT |
| Antibody 63 | 699 | GYTFTS YWMH | 805 | DPSESN | 911 | GGYDG WDYAI DY | 1017 | RSSQSL ARFYGL TYLS | 1123 | GISNRF S | 1229 | LQGTH QPYT |

TABLE 1-continued

Sequences of CDRs

| Antibody | | | | | | | | | | | |
|---|---|---|---|---|---|---|---|---|---|---|---|
| Antibody 64 | GYTFTS YWMH | 700 | DPSESN | 806 | GGYDG WDYAI DY | 912 | RSSQSL ASSYGN TYLS | 1018 | GISNRF S | 1124 | LQGTH QPYT | 1230 |
| Antibody 65 | GYTFTS YWMH | 701 | DPSESN | 807 | GGYDG WDYAI DY | 913 | RSSQSL ATSYGN TYLS | 1019 | GISNRF S | 1125 | LQGTH QPYT | 1231 |
| Antibody 66 | GYTFTS YWMH | 702 | DPSESN | 808 | GGYDG WDYAI DY | 914 | RSSQSL ATYYGI TYLS | 1020 | GISNRF S | 1126 | LQGTH QPYT | 1232 |
| Antibody 67 | GYTFTS YWMH | 703 | DPSESN | 809 | GGYDG WDYAI DY | 915 | RSSQSL ATYYG LTYLS | 1021 | GISNRF S | 1127 | LQGTH QPYT | 1233 |
| Antibody 68 | GYTFTS YWMH | 704 | DPSESN | 810 | GGYDG WDYAI DY | 916 | RSSQSL AVSYG NTYLS | 1022 | GISNRF S | 1128 | LQGTH QPYT | 1234 |
| Antibody 69 | GYTFTS YWMH | 705 | DPSESN | 811 | GGYDG WDYAI DY | 917 | RSSQSL AVSYG NTYLS | 1023 | GISNRF S | 1129 | LQGTH QPYT | 1235 |
| Antibody 70 | GYTFTS YWMH | 706 | DPSESN | 812 | GGYDG WDYAI DY | 918 | RSSQSL AYFYGI TYLS | 1024 | GISNRF S | 1130 | LQGTH QPYT | 1236 |
| Antibody 71 | GYTFTS YWMH | 707 | DPSESN | 813 | GGYDG WDYAI DY | 919 | RSSQSL AYLYGI TYLS | 1025 | GISNRF S | 1131 | LQGTH QPYT | 1237 |
| Antibody 72 | GYTFTS YWMH | 708 | DPSESN | 814 | GGYDG WDYAI DY | 920 | RSSQSL AKSYGI TYLS | 1026 | GISNRF S | 1132 | LQGTH QPYT | 1238 |
| Antibody 73 | GYTFTS YWMH | 709 | DPSESN | 815 | GGYDG WDYAI DY | 921 | RSSQSL AKSYGL TYLS | 1027 | GISNRF S | 1133 | LQGTH QPYT | 1239 |
| Antibody 74 | GYTFTS YWMH | 710 | DPSESN | 816 | GGYDG WDYAI DY | 922 | RSSQSL AKFYG NTYLS | 1028 | GISNRF S | 1134 | LQGTH QPYT | 1240 |
| Antibody 75 | GYTFTS YWMH | 711 | DPSESN | 817 | GGYDG WDYAI DY | 923 | RSSQSL AKIYGN TYLS | 1029 | GISNRF S | 1135 | LQGTH QPYT | 1241 |

TABLE 1-continued

Sequences of CDRs

| Antibody | | | | | | | | | | | | |
|---|---|---|---|---|---|---|---|---|---|---|---|---|
| Antibody 76 | 712 | GYTFTS YWMH | 818 | DPSESN | 924 | GGYDG WDYAI DY | 1030 | RSSQSL AKLYG NTYLS | 1136 | GISNRF S | 1242 | LQGTH QPYT |
| Antibody 77 | 713 | GYTFTS YWMH | 819 | DPSESN | 925 | GGYDG WDYAI DY | 1031 | RSSQSL AKMYG NTYLS | 1137 | GISNRF S | 1243 | LQGTH QPYT |
| Antibody 78 | 714 | GYTFTS YWMH | 820 | DPSESN | 926 | GGYDG WDYAI DY | 1032 | RSSQSL AKQYG NTYLS | 1138 | GISNRF S | 1244 | LQGTH QPYT |
| Antibody 79 | 715 | GYTFTS YWMH | 821 | DPSESN | 927 | GGYDG WDYAI DY | 1033 | RSSQSL AKYYG NTYLS | 1139 | GISNRF S | 1245 | LQGTH QPYT |
| Antibody 80 | 716 | GYTFTS YWMH | 822 | DPSESN | 928 | GGYDG WDYAI DY | 1034 | RSSQSL AKSHG NTYLS | 1140 | GISNRF S | 1246 | LQGTH QPYT |
| Antibody 81 | 717 | GYTFTS YWMH | 823 | DPSESN | 929 | GGYDG WDYAI DY | 1035 | RSSQSL AKSYG NTYLS | 1141 | FISNRFS | 1247 | LQGTH QPYT |
| Antibody 82 | 718 | GYTFTS YWMH | 824 | DPSESN | 930 | GGYDG WDYAI DY | 1036 | RSSQSL AKSYG NTYLS | 1142 | PISNRFS | 1248 | LQGTH QPYT |
| Antibody 83 | 719 | GYTFTS YWMH | 825 | DPSESN | 931 | GGYDG WDYAI DY | 1037 | RSSQSL AKSYG NTYLS | 1143 | YISNRF S | 1249 | LQGTH QPYT |
| Antibody 84 | 720 | GYTFTS YWMH | 826 | DPSESN | 932 | GGYDG WDYAI DY | 1038 | RSSQSL AKSYG NTYLS | 1144 | GISNRF S | 1250 | LQFTHQ PYT |
| Antibody 85 | 721 | GYTFTS YWMH | 827 | DPSESN | 933 | GGYDG WDYAI DY | 1039 | RSSQSL AKSYG NTYLS | 1145 | GISNRF S | 1251 | LQFTIQ FYT |
| Antibody 86 | 722 | GYTFTS YWMH | 828 | DPSESN | 934 | GGYDG WDYAI DY | 1040 | RSSQSL AKSYG NTYLS | 1146 | GISNRF S | 1252 | LQFTIQ VYT |
| Antibody 87 | 723 | GYTFTS YWMH | 829 | DPSESN | 935 | GGYDG WDYAI DY | 1041 | RSSQSL AKSYG NTYLS | 1147 | GISNRF S | 1253 | LQFTIQ PYI |

TABLE 1-continued

Sequences of CDRs

| Antibody 88 | 724 | GYTFTS YWMH | 830 | DPSESN | 936 | GGYDG WDYAI DY | 1042 | RSSQSL AKSYG NTYLS | 1148 | GISNRF S | 1254 | LQFTHQ FYT |
|---|---|---|---|---|---|---|---|---|---|---|---|---|
| Antibody 89 | 725 | GYTFTS YWMH | 831 | DPSESN | 937 | GGYDG WDYAI DY | 1043 | RSSQSL AKSYG NTYLS | 1149 | GISNRF S | 1255 | LQFTHQ IYI |
| Antibody 90 | 726 | GYTFTS YWMH | 832 | DPSESN | 938 | GGYDG WDYAI DY | 1044 | RSSQSL AKSYG NTYLS | 1150 | GISNRF S | 1256 | LQFTHQ PYI |
| Antibody 91 | 727 | GYTFTS YWMH | 833 | DPSESN | 939 | GGYDG WDYAI DY | 1045 | RSSQSL AKSYG NTYLS | 1151 | GISNRF S | 1257 | LQRTHQ PYT |
| Antibody 92 | 728 | GYTFTS YWMH | 834 | DPSESN | 940 | GGYDG WDYAI DY | 1046 | RSSQSL AKSYG NTYLS | 1152 | GISNRF S | 1258 | LQRTIQ VVI |
| Antibody 93 | 729 | GYTFTS YWMH | 835 | DPSESN | 941 | GGYDG WDYAI DY | 1047 | RSSQSL AKSYG NTYLS | 1153 | GISNRF S | 1259 | LQRTIQ YYT |
| Antibody 94 | 730 | GYTFTS YWMH | 836 | DPSESN | 942 | GGYDG WDYAI DY | 1048 | RSSQSL AKSYG NTYLS | 1154 | GISNRF S | 1260 | LQVTH QPYT |
| Antibody 95 | 731 | GYTFTS YWMH | 837 | DPSESN | 943 | GGYDG WDYAI DY | 1049 | RSSQSL AKSYG NTYLS | 1155 | GISNRF S | 1261 | LQWTH QPYT |
| Antibody 96 | 732 | GYTFTS YWMH | 838 | DPSESN | 944 | GGYDG WDYAI DY | 1050 | RSSQSL AKSYG NTYLS | 1156 | GISNRF S | 1262 | LQYTH QPYT |
| Antibody 97 | 733 | GYTFTS YWMH | 839 | DPSESN | 945 | GGYDG WDYAI DY | 1051 | RSSQSL AKSYG NTYLS | 1157 | GISNRF S | 1263 | LQYTIQ FYI |
| Antibody 98 | 734 | GYTFTS YWMH | 840 | DPSESN | 946 | GGYDG WDYAI DY | 1052 | RSSQSL AKSYG NTYLS | 1158 | GISNRF S | 1264 | LQYTH QFYI |
| Antibody 99 | 735 | GYTFTS YWMH | 841 | DPSESN | 947 | GGYDG WDYAI DY | 1053 | RSSQSL AKSYG NTYLS | 1159 | GISNRF S | 1265 | LQYTIQ PYT |

TABLE 1-continued

Sequences of CDRs

| Antibody | | | | | | |
|---|---|---|---|---|---|---|
| Antibody 100 | 736 GYTFTS YWMH | 842 DPSESN | 948 GGYDG WDYAI DY | 1054 RSSQSL AKSYG NTYLS | 1160 GISNRF S | 1266 LQGTW QPYT |
| Antibody 101 | 737 GYTFTS YWMH | 843 DPSESN | 949 GGYDG WDYAI DY | 1055 RSSQSL AKSYG NTYLS | 1161 GISNRF S | 1267 LQGTH QFYT |
| Antibody 102 | 738 GYTFTS YWMH | 844 DPSESN | 950 GGYDG WDYAI DY | 1056 RSSQSL AKSYG NTYLS | 1162 GISNRF S | 1268 LQGTH QIYT |
| Antibody 103 | 739 GYTFTS YWMH | 845 DPSESN | 951 GGYDG WDYAI DY | 1057 RSSQSL AKSYG NTYLS | 1163 GISNRF S | 1269 LQGTH QVYT |
| Antibody 104 | 740 GYTFTS YWMH | 846 DPSESN | 952 GGYDG WDYAI DY | 1058 RSSQSL AKSYG NTYLS | 1164 GISNRF S | 1270 LQGTH QYYT |
| Antibody 105 | 741 GYTFTS YWMH | 847 DPSESN | 953 GGYDG WDYAI DY | 1059 RSSQSL AKSYG NTYLS | 1165 GISNRF S | 1271 LQGTH QPYI |
| Antibody 106 | 742 GYTFTS YWMH | 848 DPSESN | 954 GGYDG WDYAI DY | 1060 RSSQSL AKSYG NTYLS | 1166 GISNRF S | 1272 LQGTH QPYR |

IMGT Numbering

| Antibody | | | | | | |
|---|---|---|---|---|---|---|
| Antibody 1 | 1273 GGTFTS YW | 1379 IDPSESN T | 1485 ARGGY DGWDY AIDY | 1591 QSLAKS YGNTY | GIS | 1803 LQGTH QPYT |
| Antibody 2 | 1274 GYTFTS YW | 1380 IDPSESN T | 1486 ARGGY DGWDY AIDY | 1592 QSLAKS YGNTY | GIS | 1804 LQGTH QPYT |
| Antibody 3 | 1275 GYTFTI YW | 1381 IDPSESN T | 1487 ARGGY DGWDY AIDY | 1593 QSLAKS YGNTY | GIS | 1805 LQGTH QPYT |
| Antibody 4 | 1276 GYTFTV YW | 1382 IDPSESN T | 1488 ARGGY DGWDY AIDY | 1594 QSLAKS YGNTY | GIS | 1806 LQGTH QPYT |
| Antibody 5 | 1277 GYTFTS MW | 1383 IDPSESN T | 1489 ARGGY DGWDY AIDY | 1595 QSLAKS YGNTY | GIS | 1807 LQGTH QPYT |

TABLE 1-continued

Sequences of CDRs

| | | | | | | |
|---|---|---|---|---|---|---|
| Antibody 6 | 1278 GYTFTS QW | 1384 IDPSESN T | 1490 ARGGY DGWDY AIDY | 1596 QSLAKS YGNTY | GIS | 1808 LQGTH QPYT |
| Antibody 7 | 1279 GYTFTS YW | 1385 IIPSESN T | 1491 ARGGY DGWDY AIDY | 1597 QSLAKS YGNTY | GIS | 1809 LQGTH QPYT |
| Antibody 8 | 1280 GYTFTS YW | 1386 IIPLESN T | 1492 ARGGY DGWDY AIDY | 1598 QSLAKS YGNTY | GIS | 1810 LQGTH QPYT |
| Antibody 9 | 1281 GYTFTS YW | 1387 IIPRESN T | 1493 ARGGY DGWDY AIDY | 1599 QSLAKS YGNTY | GIS | 1811 LQGTH QPYT |
| Antibody 10 | 1282 GYTFTS YW | 1388 IIPVESN T | 1494 ARGGY DGWDY AIDY | 1600 QSLAKS YGNTY | GIS | 1812 LQGTH QPYT |
| Antibody 11 | 1283 GYTFTS YW | 1389 IRPSESN T | 1495 ARGGY DGWDY AIDY | 1601 QSLAKS YGNTY | GIS | 1813 LQGTH QPYT |
| Antibody 12 | 1284 GYTFTS YW | 1390 IRPLESN T | 1496 ARGGY DGWDY AIDY | 1602 QSLAKS YGNTY | GIS | 1814 LQGTH QPYT |
| Antibody 13 | 1285 GYTFTS YW | 1391 IRPRES NT | 1497 ARGGY DGWDY AIDY | 1603 QSLAKS YGNTY | GIS | 1815 LQGTH QPYT |
| Antibody 14 | 1286 GYTFTS YW | 1392 IRPVES NT | 1498 ARGGY DGWDY AIDY | 1604 QSLAKS YGNTY | GIS | 1816 LQGTH QPYT |
| Antibody 15 | 1287 GYTFTS YW | 1393 IDPLES NT | 1499 ARGGY DGWDY AIDY | 1605 QSLAKS YGNTY | GIS | 1817 LQGTH QPYT |
| Antibody 16 | 1288 GYTFTS YW | 1394 IDPMES NT | 1500 ARGGY DGWDY AIDY | 1606 QSLAKS YGNTY | GIS | 1818 LQGTH QPYT |
| Antibody 17 | 1289 GYTFTS YW | 1395 IDPRES NT | 1501 ARGGY DGWDY AIDY | 1607 QSLAKS YGNTY | GIS | 1819 LQGTH QPYT |
| Antibody 18 | 1290 GYTFTS YW | 1396 IDPVES NT | 1502 ARGGY DGWDY AIDY | 1608 QSLAKS YGNTY | GIS | 1820 LQGTH QPYT |

TABLE 1-continued

Sequences of CDRs

| Antibody | | | | | | | | | | | | |
|---|---|---|---|---|---|---|---|---|---|---|---|---|
| Antibody 19 | 1291 | GYTFTS YW | 1397 | IDPSESN T | 1503 | ARGGY DGWDY FIDY | 1609 | QSLAKS YGNTY | GIS | 1821 | LQGTH QPYT |  |
| Antibody 20 | 1292 | GYTFTS YW | 1398 | IDPSESN T | 1504 | ARGGY DGWDY FIYY | 1610 | QSLAKS YGNTY | GIS | 1822 | LQGTH QPYT |  |
| Antibody 21 | 1293 | GYTFTS YW | 1399 | IDPSESN T | 1505 | ARGGY DGWDY LIDY | 1611 | QSLAKS YGNTY | GIS | 1823 | LQGTH QPYT |  |
| Antibody 22 | 1294 | GYTFTS YW | 1400 | IDPSESN T | 1506 | ARGGY DGWDY VIDY | 1612 | QSLAKS YGNTY | GIS | 1824 | LQGTH QPYT |  |
| Antibody 23 | 1295 | GYTFTS YW | 1401 | IDPSESN T | 1507 | ARGGY DGWDY VIYY | 1613 | QSLAKS YGNTY | GIS | 1825 | LQGTH QPYT |  |
| Antibody 24 | 1296 | GYTFTS YW | 1402 | IDPSESN T | 1508 | ARGGY DGWDY WIDY | 1614 | QSLAKS YGNTY | GIS | 1826 | LQGTH QPYT |  |
| Antibody 25 | 1297 | GYTFTS YW | 1403 | IDPSESN T | 1509 | ARGGY DGWDY YIDY | 1615 | QSLAKS YGNTY | GIS | 1827 | LQGTH QPYT |  |
| Antibody 26 | 1298 | GYTFTS YW | 1404 | IDPSESN T | 1510 | ARGGY DGWDY YIYY | 1616 | QSLAKS YGNTY | GIS | 1828 | LQGTH QPYT |  |
| Antibody 27 | 1299 | GYTFTS YW | 1405 | IDPSESN T | 1511 | IRGGYD GWDYA IDY | 1617 | QSLAKS YGNTY | GIS | 1829 | LQGTH QPYT |  |
| Antibody 28 | 1300 | GYTFTS YW | 1406 | IDPSESN T | 1512 | LRGGY DGWDY AIDY | 1618 | QSLAKS YGNTY | GIS | 1830 | LQGTH QPYT |  |
| Antibody 29 | 1301 | GYTFTS YW | 1407 | IDPSESN T | 1513 | MRGGY DGWDY AIDY | 1619 | QSLAKS YGNTY | GIS | 1831 | LQGTH QPYT |  |
| Antibody 30 | 1302 | GYTFTS YW | 1408 | IDPSESN T | 1514 | RRGGY DGWDY AIDY | 1620 | QSLAKS YGNTY | GIS | 1832 | LQGTH QPYT |  |

TABLE 1-continued

Sequences of CDRs

| Antibody | | | | | | | | | | | |
|---|---|---|---|---|---|---|---|---|---|---|---|
| Antibody 31 | 1303 | GYTFTS YW | 1409 | IDPSESN T | 1515 | VRGGY DGWDY AIDY | 1621 | QSLAKS YGNTY | GIS | 1833 | LQGTH QPYT |
| Antibody 32 | 1304 | GYTFTS YW | 1410 | IDPSESN T | 1516 | ARGGY WGWDY AIDY | 1622 | QSLAKS YGNTY | GIS | 1834 | LQGTH QPYT |
| Antibody 33 | 1305 | GYTFTS YW | 1411 | IDPSESN T | 1517 | ARGGY YGWDY AIDY | 1623 | QSLAKS YGNTY | GIS | 1835 | LQGTH QPYT |
| Antibody 34 | 1306 | GYTFTS YW | 1412 | IDPSESN T | 1518 | ARGGY DGWDY AIFY | 1624 | QSLAKS YGNTY | GIS | 1836 | LQGTH QPYT |
| Antibody 35 | 1307 | GYTFTS YW | 1413 | IDPSESN T | 1519 | ARGGY DGWDY AIMY | 1625 | QSLAKS YGNTY | GIS | 1837 | LQGTH QPYT |
| Antibody 36 | 1308 | GYTFTS YW | 1414 | IDPSESN T | 1520 | ARGGY DGWDY AIWY | 1626 | QSLAKS YGNTY | GIS | 1838 | LQGTH QPYT |
| Antibody 37 | 1309 | GYTFTS YW | 1415 | IDPSESN T | 1521 | ARGGY DGWDY AIYY | 1627 | QSLAKS YGNTY | GIS | 1839 | LQGTH QPYT |
| Antibody 38 | 1310 | GYTFTS YW | 1416 | IDPSESN T | 1522 | ARGFY DGWDY AIDY | 1628 | QSLAKS YGNTY | GIS | 1840 | LQGTH QPYT |
| Antibody 39 | 1311 | GYTFTS YW | 1417 | IDPSESN T | 1523 | ARGFY DGWDY LIDY | 1629 | QSLAKS YGNTY | GIS | 1841 | LQGTH QPYT |
| Antibody 40 | 1312 | GYTFTS YW | 1418 | IDPSESN T | 1524 | ARGFY DGWDY AIYY | 1630 | QSLAKS YGNTY | GIS | 1842 | LQGTH QPYT |
| Antibody 41 | 1313 | GYTFTS YW | 1419 | IDPSESN T | 1525 | ARGMY DGWDY AIDY | 1631 | QSLAKS YGNTY | GIS | 1843 | LQGTH QPYT |
| Antibody 42 | 1314 | GYTFTS YW | 1420 | IDPSESN T | 1526 | ARGRY DGWDY AIDY | 1632 | QSLAKS YGNTY | GIS | 1844 | LQGTH QPYT |

TABLE 1-continued

Sequences of CDRs

| Antibody | | | | | | | | | | |
|---|---|---|---|---|---|---|---|---|---|---|
| Antibody 43 | 1315 | GYTFTS YW | 1421 | IDPSESN T | 1527 | ARGVV DGWDY AIDY | 1633 | QSLAKS YGNTY | GIS | 1845 | LQGTH QPYT |
| Antibody 44 | 1316 | GYTFTS YW | 1422 | IDPSESN T | 1528 | ARGGY DIWDY AIDY | 1634 | QSLAKS YGNTY | GIS | 1846 | LQGTH QPYT |
| Antibody 45 | 1317 | GYTFTS YW | 1423 | IDPSESN T | 1529 | ARGGY DLWDY AIDY | 1635 | QSLAKS YGNTY | GIS | 1847 | LQGTH QPYT |
| Antibody 46 | 1318 | GYTFTS YW | 1424 | IDPSESN T | 1530 | ARGGY DVWDY AIDY | 1636 | QSLAKS YGNTY | GIS | 1848 | LQGTH QPYT |
| Antibody 47 | 1319 | GYTFTS YW | 1425 | IDPSESN T | 1531 | ARPGY DGWDY AIDY | 1637 | QSLAKS YGNTY | GIS | 1849 | LQGTH QPYT |
| Antibody 48 | 1320 | GYTFTS YW | 1426 | IDPSESN T | 1532 | ARYGY DGWDY AIDY | 1638 | QSLAKS YGNTY | GIS | 1850 | LQGTH QPYT |
| Antibody 49 | 1321 | GYTFTS YW | 1427 | IDPSESN T | 1533 | ARGGY DGWDY AIDY | 1639 | QSLAAS YGNTY | GIS | 1851 | LQGTH QPYT |
| Antibody 50 | 1322 | GYTFTS YW | 1428 | IDPSESN T | 1534 | ARGGY DGWDY AIDY | 1640 | QSLADS YGNTY | GIS | 1852 | LQGTH QPYT |
| Antibody 51 | 1323 | GYTFTS YW | 1429 | IDPSESN T | 1535 | ARGGY DGWDY AIDY | 1641 | QSLAIS YGNTY | GIS | 1853 | LQGTH QPYT |
| Antibody 52 | 1324 | GYTFTS YW | 1430 | IDPSESN T | 1536 | ARGGY DGWDY AIDY | 1642 | QSLAIF YGNTY | GIS | 1854 | LQGTH QPYT |
| Antibody 53 | 1325 | GYTFTS YW | 1431 | IDPSESN T | 1537 | ARGGY DGWDY AIDY | 1643 | QSLAIF YGITY | GIS | 1855 | LQGTH QPYT |
| Antibody 54 | 1326 | GYTFTS YW | 1432 | IDPSESN T | 1538 | ARGGY DGWDY AIDY | 1644 | QSLAIF YGLTY | GIS | 1856 | LQGTH QPYT |

TABLE 1-continued

Sequences of CDRs

| Antibody | | | | | | | | | | | |
|---|---|---|---|---|---|---|---|---|---|---|---|
| Antibody 55 | 1327 | GYTFTSYW | 1433 | IDPSESNT | 1539 | ARGGYDGWDYAIDY | 1645 | QSLAILYGITY | GIS | 1857 | LQGTHQPYT |
| Antibody 56 | 1328 | GYTFTSYW | 1434 | IDPSESNT | 1540 | ARGGYDGWDYAIDY | 1646 | QSLAILYGLTY | GIS | 1858 | LQGTHQPYT |
| Antibody 57 | 1329 | GYTFTSYW | 1435 | IDPSESNT | 1541 | ARGGYDGWDYAIDY | 1647 | QSLALSYGNTY | GIS | 1859 | LQGTHQPYT |
| Antibody 58 | 1330 | GYTFTSYW | 1436 | IDPSESNT | 1542 | ARGGYDGWDYAIDY | 1648 | QSLAMSYGNTY | GIS | 1860 | LQGTHQPYT |
| Antibody 59 | 1331 | GYTFTSYW | 1437 | IDPSESNT | 1543 | ARGGYDGWDYAIDY | 1649 | QSLANSYGNTY | GIS | 1861 | LQGTHQPYT |
| Antibody 60 | 1332 | GYTFTSYW | 1438 | IDPSESNT | 1544 | ARGGYDGWDYAIDY | 1650 | QSLAPSYGNTY | GIS | 1862 | LQGTHQPYT |
| Antibody 61 | 1333 | GYTFTSYW | 1439 | IDPSESNT | 1545 | ARGGYDGWDYAIDY | 1651 | QSLAQSYGNTY | GIS | 1863 | LQGTHQPYT |
| Antibody 62 | 1334 | GYTFTSYW | 1440 | IDPSESNT | 1546 | ARGGYDGWDYAIDY | 1652 | QSLARSYGNTY | GIS | 1864 | LQGTHQPYT |
| Antibody 63 | 1335 | GYTFTSYW | 1441 | IDPSESNT | 1547 | ARGGYDGWDYAIDY | 1653 | QSLARFYGLTY | GIS | 1865 | LQGTHQPYT |
| Antibody 64 | 1336 | GYTFTSYW | 1442 | IDPSESNT | 1548 | ARGGYDGWDYAIDY | 1654 | QSLASSYGNTY | GIS | 1866 | LQGTHQPYT |
| Antibody 65 | 1337 | GYTFTSYW | 1443 | IDPSESNT | 1549 | ARGGYDGWDYAIDY | 1655 | QSLATSYGNTY | GIS | 1867 | LQGTHQPYT |
| Antibody 66 | 1338 | GYTFTSYW | 1444 | IDPSESNT | 1550 | ARGGYDGWDYAIDY | 1656 | QSLATYYGITY | GIS | 1868 | LQGTHQPYT |

TABLE 1-continued

Sequences of CDRs

| Antibody | | | | | | | | | | | |
|---|---|---|---|---|---|---|---|---|---|---|---|
| Antibody 67 | 1339 | GYTFTS YW | 1445 | IDPSESN T | 1551 | ARGGY DGWDY AIDY | 1657 | QSLATY YGLTY | GIS | 1869 | LQGTH QPYT |
| Antibody 68 | 1340 | GYTFTS YW | 1446 | IDPSESN T | 1552 | ARGGY DGWDY AIDY | 1658 | QSLAVS YGNTY | GIS | 1870 | LQGTH QPYT |
| Antibody 69 | 1341 | GYTFTS YW | 1447 | IDPSESN T | 1553 | ARGGY DGWDY AIDY | 1659 | QSLAYS YGNTY | GIS | 1871 | LQGTH QPYT |
| Antibody 70 | 1342 | GYTFTS YW | 1448 | IDPSESN T | 1554 | ARGGY DGWDY AIDY | 1660 | QSLAYF YGITY | GIS | 1872 | LQGTH QPYT |
| Antibody 71 | 1343 | GYTFTS YW | 1449 | IDPSESN T | 1555 | ARGGY DGWDY AIDY | 1661 | QSLAYL YGITY | GIS | 1873 | LQGTH QPYT |
| Antibody 72 | 1344 | GYTFTS YW | 1450 | IDPSESN T | 1556 | ARGGY DGWDY AIDY | 1662 | QSLAKS YGITY | GIS | 1874 | LQGTH QPYT |
| Antibody 73 | 1345 | GYTFTS YW | 1451 | IDPSESN T | 1557 | ARGGY DGWDY AIDY | 1663 | QSLAKS YGLTY | GIS | 1875 | LQGTH QPYT |
| Antibody 74 | 1346 | GYTFTS YW | 1452 | IDPSESN T | 1558 | ARGGY DGWDY AIDY | 1664 | QSLAKF YGNTY | GIS | 1876 | LQGTH QPYT |
| Antibody 75 | 1347 | GYTFTS YW | 1453 | IDPSESN T | 1559 | ARGGY DGWDY AIDY | 1665 | QSLAKI YGNTY | GIS | 1877 | LQGTH QPYT |
| Antibody 76 | 1348 | GYTFTS YW | 1454 | IDPSESN T | 1560 | ARGGY DGWDY AIDY | 1666 | QSLAKL YGNTY | GIS | 1878 | LQGTH QPYT |
| Antibody 77 | 1349 | GYTFTS YW | 1455 | IDPSESN T | 1561 | ARGGY DGWDY AIDY | 1667 | QSLAK MYGNT Y | GIS | 1879 | LQGTH QPYT |
| Antibody 78 | 1350 | GYTFTS YW | 1456 | IDPSESN T | 1562 | ARGGY DGWDY AIDY | 1668 | QSLAKQ YGNTY | GIS | 1880 | LQGTH QPYT |

TABLE 1-continued

Sequences of CDRs

| Antibody | | | | | | | | | | | | |
|---|---|---|---|---|---|---|---|---|---|---|---|---|
| Antibody 79 | GYTFTS YW | 1351 | IDPSESN T | 1457 | ARGGY DGWDY AIDY | 1563 | QSLAKY YGNTY | 1669 | GIS | LQGTH QPYT | 1881 |
| Antibody 80 | GYTFTS YW | 1352 | IDPSESN T | 1458 | ARGGY DGWDY AIDY | 1564 | QSLAKS HGNTY | 1670 | GIS | LQGTH QPYT | 1882 |
| Antibody 81 | GYTFTS YW | 1353 | IDPSESN T | 1459 | ARGGY DGWDY AIDY | 1565 | QSLAKS YGNTY | 1671 | FIS | LQGTH QPYT | 1883 |
| Antibody 82 | GYTFTS YW | 1354 | IDPSESN T | 1460 | ARGGY DGWDY AIDY | 1566 | QSLAKS YGNTY | 1672 | PIS | LQGTH QPYT | 1884 |
| Antibody 83 | GYTFTS YW | 1355 | IDPSESN T | 1461 | ARGGY DGWDY AIDY | 1567 | QSLAKS YGNTY | 1673 | YIS | LQGTH QPYT | 1885 |
| Antibody 84 | GYTFTS YW | 1356 | IDPSESN T | 1462 | ARGGY DGWDY AIDY | 1568 | QSLAKS YGNTY | 1674 | GIS | LQFTHQ PYT | 1886 |
| Antibody 85 | GYTFTS YW | 1357 | IDPSESN T | 1463 | ARGGY DGWDY AIDY | 1569 | QSLAKS YGNTY | 1675 | GIS | LQFTIQ FYT | 1887 |
| Antibody 86 | GYTFTS YW | 1358 | IDPSESN T | 1464 | ARGGY DGWDY AIDY | 1570 | QSLAKS YGNTY | 1676 | GIS | LQFTIQ VYT | 1888 |
| Antibody 87 | GYTFTS YW | 1359 | IDPSESN T | 1465 | ARGGY DGWDY AIDY | 1571 | QSLAKS YGNTY | 1677 | GIS | LQFTIQ PYI | 1889 |
| Antibody 88 | GYTFTS YW | 1360 | IDPSESN T | 1466 | ARGGY DGWDY AIDY | 1572 | QSLAKS YGNTY | 1678 | GIS | LQFTHQ FYT | 1890 |
| Antibody 89 | GYTFTS YW | 1361 | IDPSESN T | 1467 | ARGGY DGWDY AIDY | 1573 | QSLAKS YGNTY | 1679 | GIS | LQFTHQ IYI | 1891 |
| Antibody 90 | GYTFTS YW | 1362 | IDPSESN T | 1468 | ARGGY DGWDY AIDY | 1574 | QSLAKS YGNTY | 1680 | GIS | LQFTHQ PYI | 1892 |

TABLE 1-continued

Sequences of CDRs

| Antibody | | | | | | | | | | | |
|---|---|---|---|---|---|---|---|---|---|---|---|
| Antibody 91 | 1363 | GYTFTSYW | 1469 | IDPSESNT | 1575 | ARGGYDGWDYAIDY | 1681 | QSLAKSYGNTY | GIS | 1893 | LQRTHQPYT |
| Antibody 92 | 1364 | GYTFTSYW | 1470 | IDPSESNT | 1576 | ARGGYDGWDYAIDY | 1682 | QSLAKSYGNTY | GIS | 1894 | LQRTIQVYI |
| Antibody 93 | 1365 | GYTFTSYW | 1471 | IDPSESNT | 1577 | ARGGYDGWDYAIDY | 1683 | QSLAKSYGNTY | GIS | 1895 | LQRTIQYYT |
| Antibody 94 | 1366 | GYTFTSYW | 1472 | IDPSESNT | 1578 | ARGGYDGWDYAIDY | 1684 | QSLAKSYGNTY | GIS | 1896 | LQVTHQPYT |
| Antibody 95 | 1367 | GYTFTSYW | 1473 | IDPSESNT | 1579 | ARGGYDGWDYAIDY | 1685 | QSLAKSYGNTY | GIS | 1897 | LQWTHQPYT |
| Antibody 96 | 1368 | GYTFTSYW | 1474 | IDPSESNT | 1580 | ARGGYDGWDYAIDY | 1686 | QSLAKSYGNTY | GIS | 1898 | LQYTHQPYT |
| Antibody 97 | 1369 | GYTFTSYW | 1475 | IDPSESNT | 1581 | ARGGYDGWDYAIDY | 1687 | QSLAKSYGNTY | GIS | 1899 | LQYTIQFYI |
| Antibody 98 | 1370 | GYTFTSYW | 1476 | IDPSESNT | 1582 | ARGGYDGWDYAIDY | 1688 | QSLAKSYGNTY | GIS | 1900 | LQYTHQFYI |
| Antibody 99 | 1371 | GYTFTSYW | 1477 | IDPSESNT | 1583 | ARGGYDGWDYAIDY | 1689 | QSLAKSYGNTY | GIS | 1901 | LQGTIQPYT |
| Antibody 100 | 1372 | GYTFTSYW | 1478 | IDPSESNT | 1584 | ARGGYDGWDYAIDY | 1690 | QSLAKSYGNTY | GIS | 1902 | LQGTWQPYT |
| Antibody 101 | 1373 | GYTFTSYW | 1479 | IDPSESNT | 1585 | ARGGYDGWDYAIDY | 1691 | QSLAKSYGNTY | GIS | 1903 | LQGTHQFYT |
| Antibody 102 | 1374 | GYTFTSYW | 1480 | IDPSESNT | 1586 | ARGGYDGWDYAIDY | 1692 | QSLAKSYGNTY | GIS | 1904 | LQGTHQIYT |

TABLE 1-continued

Sequences of CDRs

| Antibody | | | | | | | | | | |
|---|---|---|---|---|---|---|---|---|---|---|
| Antibody 103 | 1375 | GYTFTS YW | 1481 | IDPSESN T | 1587 | ARGGY DGWDY AIDY | 1693 | QSLAKS YGNTY | GIS | 1905 | LQGTH QVYT |
| Antibody 104 | 1376 | GYTFTS YW | 1482 | IDPSESN T | 1588 | ARGGY DGWDY AIDY | 1694 | QSLAKS YGNTY | GIS | 1906 | LQGTH QYYT |
| Antibody 105 | 1377 | GYTFTS YW | 1483 | IDPSESN T | 1589 | ARGGY DGWDY AIDY | 1695 | QSLAKS YGNTY | GIS | 1907 | LQGTH QPYI |
| Antibody 106 | 1378 | GYTFTS YW | 1484 | IDPSESN T | 1590 | ARGGY DGWDY AIDY | 1696 | QSLAKS YGNTY | GIS | 1908 | LQGTH QPYR |

In some embodiments, the α4β7 integrin binding protein comprises a heavy chain variable region comprising a CDR1, CDR2, and CDR3 as listed in Table 1.

In some embodiments, the α4β7 integrin binding protein comprises a light chain variable region comprising a CDR1, CDR2, and CDR3 as listed in Table 1.

In some embodiments, the α4β7 integrin binding protein comprises a heavy chain variable region comprising (a) a CDR1 having an amino acid sequence according to any one of SEQ ID NOs: 1-106, (b) a CDR2 having an amino acid sequence according to any one of SEQ ID NOs: 107-212, and (c) a CDR3 having an amino acid sequence according to any one of SEQ ID NOs: 213-318. In some embodiments, the α4β7 integrin binding protein comprises a light chain variable region comprising (a) a CDR1 having an amino acid sequence according to any one of SEQ ID NOs: 319-424, (b) a CDR2 having an amino acid sequence according to any one of SEQ ID NOs: 425-530, and (c) a CDR3 having an amino acid sequence according to any one of SEQ ID NOs: 531-536.

In some embodiments, the α4β7 integrin binding protein comprises a heavy chain variable region comprising (a) a CDR1 having an amino acid sequence according to any one of SEQ ID NOs: 637-742, (b) a CDR2 having an amino acid sequence according to any one of SEQ ID NOs: 743-848, and (c) a CDR3 having an amino acid sequence according to any one of SEQ ID NOs: 849-954. In some embodiments, the α4β7 integrin binding protein comprises a light chain variable region comprising (a) a CDR1 having an amino acid sequence according to any one of SEQ ID NOs: 955-1060, (b) a CDR2 having an amino acid sequence according to any one of SEQ ID NOs: 1061-1166, and (c) a CDR3 having an amino acid sequence according to any one of SEQ ID NOs: 1167-1272.

In some embodiments, the α4β7 integrin binding protein comprises a heavy chain In some embodiments, the α4β7 integrin binding protein comprises a heavy chain variable region comprising (a) a CDR1 having an amino acid sequence according to any one of SEQ ID NOs: 1273-1378, (b) a CDR2 having an amino acid sequence according to any one of SEQ ID NOs: 1378-1484, and (c) a CDR3 having an amino acid sequence according to any one of SEQ ID NOs: 1485-1590. In some embodiments, the α4β7 integrin binding protein comprises a light chain variable region comprising (a) a CDR1 having an amino acid sequence according to any one of SEQ ID NOs: 1591-1696, (b) a CDR2 having an amino acid sequence according to any one of GIS, YIS, FIS, and PIS, and (c) a CDR3 having an amino acid sequence according to any one of SEQ ID NOs: 1803-1908.

Amino acid sequences of exemplary heavy chain variable regions (VH) and light chain variable regions (VL) of α4β7 integrin binding proteins are provided in Table 2.

TABLE 2

Sequences of heavy chain variable regions (VH) and light chain variable regions (VL) of α4β7 integrin binding proteins

| Antibody | SEQ ID NO | VH Amino Acid Sequence | SEQ ID NO | VL Amino Acid Sequence |
|---|---|---|---|---|
| Antibody 1 | 1909 | EVQLVQSGAEVKKPGSSV KVSCKASGGTFTSYWMH WVRQAPGQGLEWMGEID PSESNTNYNQKFKGRATI TADISTSTAYMELSSLRSE DTAVYYCARGGYDGWD YAIDYWGQGTLVTVSS | 2015 | DVVMTQTPLSLPVTPGQPASI SCRSSQSLAKSYGNTYLSWY LQKPGQSPQLLIYGISNRFSG VPDRFSGSGSGTDFTLKISRV EAEDVGVYYCLQGTHQPYTF GQGTKLEIK |
| Antibody 2 | 1910 | EVQLVESGGGVVQPGRSL RLSCAASGYTFTSYWMH WVRQAPGKGLEWIGEIDP SESNTNYNQKFKGRATIS VDNSKNTAYLQMSSLRA EDTAVYYCARGGYDGW DYAIDYWGQGTLVTVSS | 2016 | DVVMTQTPLSLPVTPGQPASI SCRSSQSLAKSYGNTYLSWY LQKPGQSPQLLIYGISNRFSG VPDRFSGSGSGTDFTLKISRV EAEDVGVYYCLQGTHQPYTF GQGTKLEIK |
| Antibody 3 | 1911 | QVQLVQSGAEVKKPGAS VKVSCKGSGYTFTIYWM HWVRQAPGQRLEWIGEID PSESNTNYNQKFKGRVTL TVDISASTAYMELSSLRSE DTAVYYCARGGYDGWD YAIDYWGQGTLVTVSS | 2017 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 4 | 1912 | QVQLVQSGAEVKKPGAS VKVSCKGSGYTFTVYWM HWVRQAPGQRLEWIGEID PSESNTNYNQKFKGRVTL TVDISASTAYMELSSLRSE DTAVYYCARGGYDGWD YAIDYWGQGTLVTVSS | 2018 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 5 | 1913 | QVQLVQSGAEVKKPGAS VKVSCKGSGYTFTSMWM HWVRQAPGQRLEWIGEID PSESNTNYNQKFKGRVTL TVDISASTAYMELSSLRSE DTAVYYCARGGYDGWD YAIDYWGQGTLVTVSS | 2019 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |

TABLE 2-continued

| Sequences of heavy chain variable regions (VH) and light chain variable regions (VL) of α4β7 integrin binding proteins | | | | |
|---|---|---|---|---|
| Antibody | SEQ ID NO | VH Amino Acid Sequence | SEQ ID NO | VL Amino Acid Sequence |
| Antibody 6 | 1914 | QVQLVQSGAEVKKPGAS VKVSCKGSGYTFTSQWM HWVRQAPGQRLEWIGEID PSESNTNYNQKFKGRVTL TVDISASTAYMELSSLRSE DTAVYYCARGGYDGWD YAIDYWGQGTLVTVSS | 2020 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 7 | 1915 | QVQLVQSGAEVKKPGAS VKVSCKGSGYTFTSYWM HWVRQAPGQRLEWIGEII PSESNTNYNQKFKGRVTL TVDISASTAYMELSSLRSE DTAVYYCARGGYDGWD YAIDYWGQGTLVTVSS | 2021 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 8 | 1916 | QVQLVQSGAEVKKPGAS VKVSCKGSGYTFTSYWM HWVRQAPGQRLEWIGEII PLESNTNYNQKFKGRVTL TVDISASTAYMELSSLRSE DTAVYYCARGGYDGWD YAIDYWGQGTLVTVSS | 2022 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 9 | 1917 | QVQLVQSGAEVKKPGAS VKVSCKGSGYTFTSYWM HWVRQAPGQRLEWIGEII PRESNTNYNQKFKGRVTL TVDISASTAYMELSSLRSE DTAVYYCARGGYDGWD YAIDYWGQGTLVTVSS | 2023 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 10 | 1918 | QVQLVQSGAEVKKPGAS VKVSCKGSGYTFTSYWM HWVRQAPGQRLEWIGEII PVESNTNYNQKFKGRVTL TVDISASTAYMELSSLRSE DTAVYYCARGGYDGWD YAIDYWGQGTLVTVSS | 2024 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 11 | 1919 | QVQLVQSGAEVKKPGAS VKVSCKGSGYTFTSYWM HWVRQAPGQRLEWIGEIR PSESNTNYNQKFKGRVTL TVDISASTAYMELSSLRSE DTAVYYCARGGYDGWD YAIDYWGQGTLVTVSS | 2025 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 12 | 1920 | QVQLVQSGAEVKKPGAS VKVSCKGSGYTFTSYWM HWVRQAPGQRLEWIGEIR PLESNTNYNQKFKGRVTL TVDISASTAYMELSSLRSE DTAVYYCARGGYDGWD YAIDYWGQGTLVTVSS | 2026 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 13 | 1921 | QVQLVQSGAEVKKPGAS VKVSCKGSGYTFTSYWM HWVRQAPGQRLEWIGEIR PRESNTNYNQKFKGRVTL TVDISASTAYMELSSLRSE DTAVYYCARGGYDGWD YAIDYWGQGTLVTVSS | 2027 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 14 | 1922 | QVQLVQSGAEVKKPGAS VKVSCKGSGYTFTSYWM HWVRQAPGQRLEWIGEIR PVESNTNYNQKFKGRVTL TVDISASTAYMELSSLRSE DTAVYYCARGGYDGWD YAIDYWGQGTLVTVSS | 2028 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |

TABLE 2-continued

Sequences of heavy chain variable regions (VH) and light chain variable regions
(VL) of α4β7 integrin binding proteins

| Antibody | SEQ ID NO | VH Amino Acid Sequence | SEQ ID NO | VL Amino Acid Sequence |
|---|---|---|---|---|
| Antibody 15 | 1923 | QVQLVQSGAEVKKPGAS VKVSCKGSGYTFTSYWM HWVRQAPGQRLEWIGEID PLESNTNYNQKFKGRVTL TVDISASTAYMELSSLRSE DTAVYYCARGGYDGWD YAIDYWGQGTLVTVSS | 2029 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 16 | 1924 | QVQLVQSGAEVKKPGAS VKVSCKGSGYTFTSYWM HWVRQAPGQRLEWIGEID PMESNTNYNQKFKGRVT LTVDISASTAYMELSSLRS EDTAVYYCARGGYDGW DYAIDYWGQGTLVTVSS | 2030 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 17 | 1925 | QVQLVQSGAEVKKPGAS VKVSCKGSGYTFTSYWM HWVRQAPGQRLEWIGEID PRESNTNYNQKFKGRVTL TVDISASTAYMELSSLRSE DTAVYYCARGGYDGWD YAIDYWGQGTLVTVSS | 2031 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 18 | 1926 | QVQLVQSGAEVKKPGAS VKVSCKGSGYTFTSYWM HWVRQAPGQRLEWIGEID PVESNTNYNQKFKGRVTL TVDISASTAYMELSSLRSE DTAVYYCARGGYDGWD YAIDYWGQGTLVTVSS | 2032 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 19 | 1927 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YFIDYWGQGTLVTVSS | 2033 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 20 | 1928 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YFIYYWGQGTLVTVSS | 2034 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 21 | 1929 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YLIDYWGQGTLVTVSS | 2035 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 22 | 1930 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YVIDYWGQGTLVTVSS | 2036 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 23 | 1931 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YVIYYWGQGTLVTVSS | 2037 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |

TABLE 2-continued

Sequences of heavy chain variable regions (VH) and light chain variable regions (VL) of α4β7 integrin binding proteins

| Antibody | SEQ ID NO | VH Amino Acid Sequence | SEQ ID NO | VL Amino Acid Sequence |
|---|---|---|---|---|
| Antibody 24 | 1932 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YWIDYWGQGTLVTVSS | 2038 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 25 | 1933 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YYIDYWGQGTLVTVSS | 2039 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 26 | 1934 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YYIYYWGQGTLVTVSS | 2040 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 27 | 1935 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCIRGGYDGWDY AIDYWGQGTLVTVSS | 2041 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 28 | 1936 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCLRGGYDGWD YAIDYWGQGTLVTVSS | 2042 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 29 | 1937 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCMRGGYDGWD YAIDYWGQGTLVTVSS | 2043 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 30 | 1938 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCRRGGYDGWD YAIDYWGQGTLVTVSS | 2044 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 31 | 1939 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCVRGGYDGWD YAIDYWGQGTLVTVSS | 2045 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 32 | 1940 | QVQLVQSGAEVKKPGAS VKVSCKGSGYTFTSYWM HWVRQAPGQRLEWIGEID PSESNTNYNQKFKGRVTL | 2046 | DVVMTQSPLSLPVTPGEPASI SCRSSQSLAKSYGNTYLSWY LQKPGQSPQLLIYGISNRFSG VPDRFSGSGSGTDFTLKISRV |

TABLE 2-continued

Sequences of heavy chain variable regions (VH) and light chain variable regions
(VL) of α4β7 integrin binding proteins

| Antibody | SEQ ID NO | VH Amino Acid Sequence | SEQ ID NO | VL Amino Acid Sequence |
|---|---|---|---|---|
| | | TVDISASTAYMELSSLRSE DTAVYYCARGGYWGWD YAIDYWGQGTLVTVSS | | EAEDVGVYYCLQGTHQPYTF GQGTKVEIK |
| Antibody 33 | 1941 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYYGWD YAIDYWGQGTLVTVSS | 2047 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 34 | 1942 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIFYWGQGTLVTVSS | 2048 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 35 | 1943 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIMYWGQGTLVTVSS | 2049 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 36 | 1944 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIWYWGQGTLVTVSS | 2050 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 37 | 1945 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIYYWGQGTLVTVSS | 2051 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 38 | 1946 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGFYDGWD YAIDYWGQGTLVTVSS | 2052 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 39 | 1947 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGFYDGWD YLIDYWGQGTLVTVSS | 2053 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 40 | 1948 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGFYDGWD YAIYYWGQGTLVTVSS | 2054 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 41 | 1949 | QVQLVQSGAEVKKPGAS VKVSCKGSGYTFTSYWM | 2055 | DVVMTQSPLSLPVTPGEPASI SCRSSQSLAKSYGNTYLSWY |

TABLE 2-continued

Sequences of heavy chain variable regions (VH) and light chain variable regions (VL) of α4β7 integrin binding proteins

| Antibody | SEQ ID NO | VH Amino Acid Sequence | SEQ ID NO | VL Amino Acid Sequence |
|---|---|---|---|---|
| | | HWVRQAPGQRLEWIGEID PSESNTNYNQKFKGRVTL TVDISASTAYMELSSLRSE DTAVYYCARGMYDGWD YAIDYWGQGTLVTVSS | | LQKPGQSPQLLIYGISNRFSG VPDRFSGSGSGTDFTLKISRV EAEDVGVYYCLQGTHQPYTF GQGTKVEIK |
| Antibody 42 | 1950 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGRYDGWD YAIDYWGQGTLVTVSS | 2056 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 43 | 1951 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGVYDGWD YAIDYWGQGTLVTVSS | 2057 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 44 | 1952 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDIWDY AIDYWGQGTLVTVSS | 2058 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 45 | 1953 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDLWD YAIDYWGQGTLVTVSS | 2059 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 46 | 1954 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDVWD YAIDYWGQGTLVTVSS | 2060 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 47 | 1955 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARFGYDGWD YAIDYWGQGTLVTVSS | 2061 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 48 | 1956 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARYGYDGWD YAIDYWGQGTLVTVSS | 2062 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYTF GQGTKVEIK |
| Antibody 49 | 1957 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2063 | DVVMTQSPLSLPVTPGEPASI SCRSSQSLAASYGNTYLSWY LQKPGQSPQLLIYGISNRFSG VPDRFSGSGSGTDFTLKISRV EAEDVGVYYCLQGTHQPYTF GQGTKVEIK |
| Antibody 50 | 1958 | QVQLVQSGAEVKKPGAS VKVSCKGSGYTFTSYWM HWVRQAPGQRLEWIGEID PSESNTNYNQKFKGRVTL | 2064 | DVVMTQSPLSLPVTPGEPASI SCRSSQSLADSYGNTYLSWY LQKPGQSPQLLIYGISNRFSG VPDRFSGSGSGTDFTLKISRV |

TABLE 2-continued

Sequences of heavy chain variable regions (VH) and light chain variable regions
(VL) of α4β7 integrin binding proteins

| Antibody | SEQ ID NO | VH Amino Acid Sequence | SEQ ID NO | VL Amino Acid Sequence |
|---|---|---|---|---|
| | | TVDISASTAYMELSSLRSE DTAVYYCARGGYDGWD YAIDYWGQGTLVTVSS | | EAEDVGVYYCLQGTHQPYTF GQGTKVEIK |
| Antibody 51 | 1959 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2065 | DVVMTQSPLSLPVTPGEPASI SCRSSQSLAISYGNTYLSWYL QKPGQSPQLLIYGISNRFSGVP DRFSGSGSGTDFTLKISRVEA EDVGVYYCLQGTHQPYTFGQ GTKVEIK |
| Antibody 52 | 1960 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2066 | DVVMTQSPLSLPVTPGEPASI SCRSSQSLAIFYGNTYLSWYL QKPGQSPQLLIYGISNRFSGVP DRFSGSGSGTDFTLKISRVEA EDVGVYYCLQGTHQPYTFGQ GTKVEIK |
| Antibody 53 | 1961 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2067 | DVVMTQSPLSLPVTPGEPASI SCRSSQSLAIFYGITYLSWYL QKPGQSPQLLIYGISNRFSGVP DRFSGSGSGTDFTLKISRVEA EDVGVYYCLQGTHQPYTFGQ GTKVEIK |
| Antibody 54 | 1962 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2068 | DVVMTQSPLSLPVTPGEPASI SCRSSQSLAIFYGLTYLSWYL QKPGQSPQLLIYGISNRFSGVP DRFSGSGSGTDFTLKISRVEA EDVGVYYCLQGTHQPYTFGQ GTKVEIK |
| Antibody 55 | 1963 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2069 | DVVMTQSPLSLPVTPGEPASI SCRSSQSLAILYGITYLSWYL QKPGQSPQLLIYGISNRFSGVP DRFSGSGSGTDFTLKISRVEA EDVGVYYCLQGTHQPYTFGQ GTKVEIK |
| Antibody 56 | 1964 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2070 | DVVMTQSPLSLPVTPGEPASI SCRSSQSLAILYGLTYLSWYL QKPGQSPQLLIYGISNRFSGVP DRFSGSGSGTDFTLKISRVEA EDVGVYYCLQGTHQPYTFGQ GTKVEIK |
| Antibody 57 | 1965 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2071 | DVVMTQSPLSLPVTPGEPASI SCRSSQSLALSYGNTYLSWY LQKPGQSPQLLIYGISNRFSG VPDRFSGSGSGTDFTLKISRV EAEDVGVYYCLQGTHQPYTF GQGTKVEIK |
| Antibody 58 | 1966 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2072 | DVVMTQSPLSLPVTPGEPASI SCRSSQSLAMSYGNTYLSWY LQKPGQSPQLLIYGISNRFSG VPDRFSGSGSGTDFTLKISRV EAEDVGVYYCLQGTHQPYTF GQGTKVEIK |
| Antibody 59 | 1967 | QVQLVQSGAEVKKPGAS VKVSCKGSGYTFTSYWM HWVRQAPGQRLEWIGEID PSESNTNYNQKFKGRVTL TVDISASTAYMELSSLRSE | 2073 | DVVMTQSPLSLPVTPGEPASI SCRSSQSLANSYGNTYLSWY LQKPGQSPQLLIYGISNRFSG VPDRFSGSGSGTDFTLKISRV EAEDVGVYYCLQGTHQPYTF |

TABLE 2-continued

Sequences of heavy chain variable regions (VH) and light chain variable regions (VL) of α4β7 integrin binding proteins

| Antibody | SEQ ID NO | VH Amino Acid Sequence | SEQ ID NO | VL Amino Acid Sequence |
|---|---|---|---|---|
| | | DTAVYYCARGGYDGWD YAIDYWGQGTLVTVSS | | GQGTKVEIK |
| Antibody 60 | 1968 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2074 | DVVMTQSPLSLPVTPGEPASI SCRSSQSLAPSYGNTYLSWYL QKPGQSPQLLIYGISNRFSGVP DRFSGSGSGTDFTLKISRVEA EDVGVYYCLQGTHQPYTFGQ GTKVEIK |
| Antibody 61 | 1969 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2075 | DVVMTQSPLSLPVTPGEPASI SCRSSQSLAQSYGNTYLSWY LQKPGQSPQLLIYGISNRFSG VPDRFSGSGSGTDFTLKISRV EAEDVGVYYCLQGTHQPYTF GQGTKVEIK |
| Antibody 62 | 1970 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2076 | DVVMTQSPLSLPVTPGEPASI SCRSSQSLARSYGNTYLSWY LQKPGQSPQLLIYGISNRFSG VPDRFSGSGSGTDFTLKISRV EAEDVGVYYCLQGTHQPYTF GQGTKVEIK |
| Antibody 63 | 1971 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2077 | DVVMTQSPLSLPVTPGEPASI SCRSSQSLARFYGLTYLSWYL QKPGQSPQLLIYGISNRFSGVP DRFSGSGSGTDFTLKISRVEA EDVGVYYCLQGTHQPYTFGQ GTKVEIK |
| Antibody 64 | 1972 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2078 | DVVMTQSPLSLPVTPGEPASI SCRSSQSLASSYGNTYLSWYL QKPGQSPQLLIYGISNRFSGVP DRFSGSGSGTDFTLKISRVEA EDVGVYYCLQGTHQPYTFGQ GTKVEIK |
| Antibody 65 | 1973 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2079 | DVVMTQSPLSLPVTPGEPASI SCRSSQSLATSYGNTYLSWY LQKPGQSPQLLIYGISNRFSG VPDRFSGSGSGTDFTLKISRV EAEDVGVYYCLQGTHQPYTF GQGTKVEIK |
| Antibody 66 | 1974 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2080 | DVVMTQSPLSLPVTPGEPASI SCRSSQSLATYYGITYLSWYL QKPGQSPQLLIYGISNRFSGVP DRFSGSGSGTDFTLKISRVEA EDVGVYYCLQGTHQPYTFGQ GTKVEIK |
| Antibody 67 | 1975 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2081 | DVVMTQSPLSLPVTPGEPASI SCRSSQSLATYYGLTYLSWY LQKPGQSPQLLIYGISNRFSG VPDRFSGSGSGTDFTLKISRV EAEDVGVYYCLQGTHQPYTF GQGTKVEIK |
| Antibody 68 | 1976 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2082 | DVVMTQSPLSLPVTPGEPASI SCRSSQSLAVSYGNTYLSWY LQKPGQSPQLLIYGISNRFSG VPDRFSGSGSGTDFTLKISRV EAEDVGVYYCLQGTHQPYTF GQGTKVEIK |

TABLE 2-continued

Sequences of heavy chain variable regions (VH) and light chain variable regions
(VL) of α4β7 integrin binding proteins

| Antibody | SEQ ID NO | VH Amino Acid Sequence | SEQ ID NO | VL Amino Acid Sequence |
|---|---|---|---|---|
| Antibody 69 | 1977 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2083 | DVVMTQSPLSLPVTPGEPASI SCRSSQSLAYSYGNTYLSWY LQKPGQSPQLLIYGISNRFSG VPDRFSGSGSGTDFTLKISRV EAEDVGVYYCLQGTHQPYTF GQGTKVEIK |
| Antibody 70 | 1978 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2084 | DVVMTQSPLSLPVTPGEPASI SCRSSQSLAYFYGITYLSWYL QKPGQSPQLLIYGISNRFSGVP DRFSGSGSGTDFTLKISRVEA EDVGVYYCLQGTHQPYTFGQ GTKVEIK |
| Antibody 71 | 1979 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2085 | DVVMTQSPLSLPVTPGEPASI SCRSSQSLAYLYGITYLSWYL QKPGQSPQLLIYGISNRFSGVP DRFSGSGSGTDFTLKISRVEA EDVGVYYCLQGTHQPYTFGQ GTKVEIK |
| Antibody 72 | 1980 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2086 | DVVMTQSPLSLPVTPGEPASI SCRSSQSLAKSYGITYLSWYL QKPGQSPQLLIYGISNRFSGVP DRFSGSGSGTDFTLKISRVEA EDVGVYYCLQGTHQPYTFGQ GTKVEIK |
| Antibody 73 | 1981 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2087 | DVVMTQSPLSLPVTPGEPASI SCRSSQSLAKSYGLTYLSWY LQKPGQSPQLLIYGISNRFSG VPDRFSGSGSGTDFTLKISRV EAEDVGVYYCLQGTHQPYTF GQGTKVEIK |
| Antibody 74 | 1982 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2088 | DVVMTQSPLSLPVTPGEPASI SCRSSQSLAKFYGNTYLSWY LQKPGQSPQLLIYGISNRFSG VPDRFSGSGSGTDFTLKISRV EAEDVGVYYCLQGTHQPYTF GQGTKVEIK |
| Antibody 75 | 1983 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2089 | DVVMTQSPLSLPVTPGEPASI SCRSSQSLAKIYGNTYLSWYL QKPGQSPQLLIYGISNRFSGVP DRFSGSGSGTDFTLKISRVEA EDVGVYYCLQGTHQPYTFGQ GTKVEIK |
| Antibody 76 | 1984 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2090 | DVVMTQSPLSLPVTPGEPASI SCRSSQSLAKLYGNTYLSWY LQKPGQSPQLLIYGISNRFSG VPDRFSGSGSGTDFTLKISRV EAEDVGVYYCLQGTHQPYTF GQGTKVEIK |
| Antibody 77 | 1985 | QVQLVQSGAEVKKPGAS VKVSCKGSGYTFTSYWM HWVRQAPGQRLEWIGEID PSESNTNYNQKFKGRVTL | 2091 | DVVMTQSPLSLPVTPGEPASI SCRSSQSLAKMYGNTYLSWY LQKPGQSPQLLIYGISNRFSG VPDRFSGSGSGTDFTLKISRV |

TABLE 2-continued

Sequences of heavy chain variable regions (VH) and light chain variable regions (VL) of α4β7 integrin binding proteins

| Antibody | SEQ ID NO | VH Amino Acid Sequence | SEQ ID NO | VL Amino Acid Sequence |
|---|---|---|---|---|
| | | TVDISASTAYMELSSLRSE DTAVYYCARGGYDGWD YAIDYWGQGTLVTVSS | | EAEDVGVYYCLQGTHQPYTF GQGTKVEIK |
| Antibody 78 | 1986 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2092 | DVVMTQSPLSLPVTPGEPASI SCRSSQSLAKQYGNTYLSWY LQKPGQSPQLLIYGISNRFSG VPDRFSGSGSGTDFTLKISRV EAEDVGVYYCLQGTHQPYTF GQGTKVEIK |
| Antibody 79 | 1987 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2093 | DVVMTQSPLSLPVTPGEPASI SCRSSQSLAKYYGNTYLSWY LQKPGQSPQLLIYGISNRFSG VPDRFSGSGSGTDFTLKISRV EAEDVGVYYCLQGTHQPYTF GQGTKVEIK |
| Antibody 80 | 1988 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2094 | DVVMTQSPLSLPVTPGEPASI SCRSSQSLAKSHGNTYLSWY LQKPGQSPQLLIYGISNRFSG VPDRFSGSGSGTDFTLKISRV EAEDVGVYYCLQGTHQPYTF GQGTKVEIK |
| Antibody 81 | 1989 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2095 | DVVMTQSPLSLPVTPGEPASI SCRSSQSLAKSYGNTYLSWY LQKPGQSPQLLIYFISNRFSGV PDRFSGSGSGTDFTLKISRVE AEDVGVYYCLQGTHQPYTFG QGTKVEIK |
| Antibody 82 | 1990 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2096 | DVVMTQSPLSLPVTPGEPASI SCRSSQSLAKSYGNTYLSWY LQKPGQSPQLLIYPISNRFSGV PDRFSGSGSGTDFTLKISRVE AEDVGVYYCLQGTHQPYTFG QGTKVEIK |
| Antibody 83 | 1991 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2097 | DVVMTQSPLSLPVTPGEPASI SCRSSQSLAKSYGNTYLSWY LQKPGQSPQLLIYYISNRFSG VPDRFSGSGSGTDFTLKISRV EAEDVGVYYCLQGTHQPYTF GQGTKVEIK |
| Antibody 84 | 1992 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2098 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQFTHQPYTF GQGTKVEIK |
| Antibody 85 | 1993 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2099 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQFTIQFYTFG QGTKVEIK |
| Antibody 86 | 1994 | QVQLVQSGAEVKKPGAS VKVSCKGSGYTFTSYWM HWVRQAPGQRLEWIGEID PSESNTNYNQKFKGRVTL TVDISASTAYMELSSLRSE | 2100 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQFTIQVYTF |

TABLE 2-continued

| Antibody | SEQ ID NO | VH Amino Acid Sequence | SEQ ID NO | VL Amino Acid Sequence |
|---|---|---|---|---|
| | | | | Sequences of heavy chain variable regions (VH) and light chain variable regions (VL) of α4β7 integrin binding proteins |

| Antibody | SEQ ID NO | VH Amino Acid Sequence | SEQ ID NO | VL Amino Acid Sequence |
|---|---|---|---|---|
| | | DTAVYYCARGGYDGWD YAIDYWGQGTLVTVSS | | GQGTKVEIK |
| Antibody 87 | 1995 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2101 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQFTIQPYIFG QGTKVEIK |
| Antibody 88 | 1996 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2102 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQFTHQFYTF GQGTKVEIK |
| Antibody 89 | 1997 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2103 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQFTHQIYIFG QGTKVEIK |
| Antibody 90 | 1998 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2104 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQFTHQPYIF GQGTKVEIK |
| Antibody 91 | 1999 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2105 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQRTHQPYTF GQGTKVEIK |
| Antibody 92 | 2000 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2106 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQRTIQVYIFG QGTKVEIK |
| Antibody 93 | 2001 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2107 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQRTIQYYTF GQGTKVEIK |
| Antibody 94 | 2002 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2108 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQVTHQPYTF GQGTKVEIK |
| Antibody 95 | 2003 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2109 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQWTHQPYT FGQGTKVEIK |

TABLE 2-continued

Sequences of heavy chain variable regions (VH) and light chain variable regions
(VL) of α4β7 integrin binding proteins

| Antibody | SEQ ID NO | VH Amino Acid Sequence | SEQ ID NO | VL Amino Acid Sequence |
|---|---|---|---|---|
| Antibody 96 | 2004 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2110 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQYTHQPYTF GQGTKVEIK |
| Antibody 97 | 2005 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2111 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQYTIQFYIFG QGTKVEIK |
| Antibody 98 | 2006 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2112 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQYTHQFYIF GQGTKVEIK |
| Antibody 99 | 2007 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2113 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTIQPYTF GQGTKVEIK |
| Antibody 100 | 2008 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2114 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTWQPYT FGQGTKVEIK |
| Antibody 101 | 2009 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2115 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQFYTF GQGTKVEIK |
| Antibody 102 | 2010 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2116 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQIYTF GQGTKVEIK |
| Antibody 103 | 2011 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2117 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQVYTF GQGTKVEIK |
| Antibody 104 | 2012 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2118 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQYYTF GQGTKVEIK |

TABLE 2-continued

Sequences of heavy chain variable regions (VH) and light chain variable regions (VL) of α4β7 integrin binding proteins

| Antibody | SEQ ID NO | VH Amino Acid Sequence | SEQ ID NO | VL Amino Acid Sequence |
|---|---|---|---|---|
| Antibody 105 | 2013 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2119 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYIF GQGTKVEIK |
| Antibody 106 | 2014 | QVQLVQSGAEVKKPGAS VKVSCKGSGYTFTSYWM HWVRQAPGQRLEWIGEID PSESNTNYNQKFKGRVTL TVDISASTAYMELSSLRSE DTAVYYCARGGYDGWD YAIDYWGQGTLVTVSS | 2120 | DVVMTQSPLSLPVTPGEPASI SCRSSQSLAKSYGNTYLSWY LQKPGQSPQLLIYGISNRFSG VPDRFSGSGSGTDFTLKISRV EAEDVGVYYCLQGTHQPYRF GQGTKVEIK |

In some embodiments, the α4β7 integrin binding protein comprises a heavy chain variable region (VH) comprising an amino acid sequence having at least 80% sequence identity, at least 85% identity, at least 90% identity, at least 95% identity, at least 96% identity, at least 97% identity, at least 98% identity, at least 99% identity or 100% with an amino acid sequence set out in Table 2.

In some embodiments, the α4β7 integrin binding protein comprises a heavy chain variable region (VH) that comprises an amino acid sequence at least 60% (e.g., at least 70%, at least 80%, at least 85%, at least 90%, at least 91%, at least 92%, at least 93%, at least 94%, at least 95%, at least 96%, at least 97%, at least 98%, at least 99%, or 100%) identical to the heavy chain variable region (VH) of an α4β7 integrin binding protein disclosed in Table 2, and a light chain variable region (VL) that comprises an amino acid sequence at least 60% (e.g., at least 70%, at least 80%, at least 85%, at least 90%, at least 91%, at least 92%, at least 93%, at least 94%, at least 95%, at least 96%, at least 97%, at least 98%, at least 99%, or 100%) identical to the light chain variable region (VL) of the same α4β7 integrin binding protein disclosed in Table 2.

Fc Modifications

Described herein are α4β7 integrin binding proteins comprising modified Fc regions. Unless otherwise specified herein, numbering of amino acid residues in the Fc region or constant region is according to the EU numbering system, also called the EU index, as described in Kabat et al, Sequences of Proteins of Immunological Interest, 5th Ed. Public Health Service, National Institutes of Health, Bethesda, MD, 1991.

In some embodiments, the α4β7 integrin binding proteins comprise a modified Fc comprising one or more modifications. In some embodiments, the one or more modifications are located in a Fc from IgG1 (e.g., human IgG1 (hIgG1). In some embodiments, the one or more modifications are located in a Fc from IgG4 (e.g., human IgG4 (hIgG4). In some embodiments, the one or more modifications are located in a Fc from IgG2. In some embodiments, the one or more modifications promote selective binding of Fc-gamma receptors.

Amino acid sequences of exemplary Fc sequences are provided in Table 3.

TABLE 3

Fc Sequences

| Name | SEQ ID NO | Fc Sequence |
|---|---|---|
| hIgG1 | 2121 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG4 | 2122 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPSCPAPEFLGGPSVFLFPPKPKDTLMISRTPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHNHYTQKSLSLSLG K |

TABLE 3-continued

| | | Fc Sequences |
|---|---|---|

| Name | SEQ ID NO | Fc Sequence |
|---|---|---|
| IgG2 | 2123 | ASTKGPSVFPLAPCSRSTSESTAALGCLVKDYFPEPVTVSWNSGALT SGVHTFPAVLQSSGLYSLSSVVTVPSSNFGTQTYTCNVDHKPSNTKV DKTVERKCCVECPPCPAPPVAGPSVFLFPPKPKDTLMISRTPEVTCVV VDVSHEDPEVQFNWYVDGVEVHNAKTKPREEQFNSTFRVVSVLTV VHQDWLNGKEYKCKVSNKGLPAPIEKTISKTKGQPREPQVYTLPPSR EEMTKNQVSLTCLVKGFYPSDIAVEWESNGQPENNYKTTPPMLDSD GSFFLYSKLTVDKSRWQQGNVFSCSVMHEALHNHYTQKSLSLSP |
| IgG4-SP | 2124 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEFLGGPSVFLFPPKPKDTLMISRTPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHNHYTQKSLSLSLG K |
| IgG4-SPLE | 2125 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEELGGPSVFLFPPKPKDTLMISRTPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHNHYTQKSLSLSLG K |
| hIgG1-N297A | 2126 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYASTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-D265A | 2127 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVAVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALA | 2128 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LAGA | 2129 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALAGA | 2130 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALAPG | 2131 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV |

TABLE 3-continued

| | | Fc Sequences |
|---|---|---|

| Name | SEQ ID NO | Fc Sequence |
|---|---|---|
| | | DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALGAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-YTE | 2132 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLYITREPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-N297A/YTE | 2133 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLYITREPEV TCVVVDVSHEDPEVKFNWYVDGVEVHNAKTKPREEQYASTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-D265A/YTE | 2134 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLYITREPEV TCVVVAVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALA/YTE | 2135 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLYITREPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LAGA/YTE | 2136 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLYITREPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALAGA/YTE | 2137 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLYITREPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALAPG/YTE | 2138 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLYITREPEV TCVVVDVSHEDPEVKFNWYVDGVEVHNAKTKPREEQYNSTYRVVS VLTVLHQDWLNGKEYKCKVSNKALGAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LS | 2139 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYNSTYRVVS |

TABLE 3-continued

| Fc Sequences | | |
|---|---|---|
| Name | SEQ ID NO | Fc Sequence |
| | | VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHSHYTQKSLSLS PG |
| hIgG1-N297A/LS | 2140 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYASTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHSHYTQKSLSLS PG |
| hIgG1-D265A/LS | 2141 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVAVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHSHYTQKSLSLS PG |
| hIgG1-LALA/LS | 2142 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHSHYTQKSLSLS PG |
| hIgG1-LAGA/LS | 2143 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHSHYTQKSLSLS PG |
| hIgG1-LALAGA/LS | 2144 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHSHYTQKSLSLS PG |
| hIgG1-LALAPG/LS | 2145 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALGAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHSHYTQKSLSLS PG |
| hIgG1-DHS | 2146 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYNSTYRVVS VLTVDHHDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHSHYTQKSLSL SPG |
| hIgG1-N297A/DHS | 2147 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYASTYRVVS VLTVDHHDWLNGKEYKCKVSNKALPAPIEKTISKAKGQPREPQVYT LPPSRDELTKNQVSLTCLVKGFYPSDIAVEWESNGQPENNYKTTPPV |

TABLE 3-continued

| | | |
|---|---|---|
| | | Fc Sequences |

| Name | SEQ ID NO | Fc Sequence |
|---|---|---|
| | | LDSDGSFFLYSKLTVDKSRWQQGNVFSCSVMHEALHSHYTQKSLSL SPG |
| hIgG1-D265A/DHS | 2148 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVAVSHEDPEVKFNWYVDGVEVHNAKTKPREEQYNSTYRVVS VLTVDHHDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHSHYTQKSLSL SPG |
| hIgG1-LALA/DHS | 2149 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVDHHDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHSHYTQKSLSL SPG |
| hIgG1-LAGA/DHS | 2150 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRTPEV TCVVVDVSHEDPEVKFNWYVDGVEVHNAKTKPREEQYNSTYRVVS VLTVDHHDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHSHYTQKSLSL SPG |
| hIgG1-LALAGA/DHS | 2151 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRTPEV TCVVVDVSHEDPEVKFNWYVDGVEVHNAKTKPREEQYNSTYRVVS VLTVDHHDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHSHYTQKSLSL SPG |
| hIgG1-LALAPG/DHS | 2152 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVDHHDWLNGKEYKCKVSNKALGAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHSHYTQKSLSL SPG |
| hIgG4-YTE | 2153 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPSCPAPEFLGGPSVFLFPPKPKDTLYITREPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHNHYTQKSLSLSLG K |
| hIgG4-SP/YTE | 2154 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEFLGGPSVFLFPPKPKDTLYITREPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHNHYTQKSLSLSLG K |
| hIgG4-SPLE/YTE | 2155 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEELGGPSVFLFPPKPKDTLYITREPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHNHYTQKSLSLSLG K |

TABLE 3-continued

| | Fc Sequences | |
|---|---|---|
| Name | SEQ ID NO | Fc Sequence |
| hIgG4-LS | 2156 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPSCPAPEFLGGPSVFLFPPKPKDTLMISRTPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVLHEALHSYTQKSLSLSLGK |
| hIgG4-SP/LS | 2157 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEFLGGPSVFLFPPKPKDTLMISRTPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVLHEALHSYTQKSLSLSLGK |
| hIgG4-SPLE/LS | 2158 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEELGGPSVFLFPPKPKDTLMISRTPEVTCV VVDVSQEDPEVQFNWYVDGVEVHNAKTKPREEQFNSTYRVVSVLT VLHQDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVLHEALHSYTQKSLSLSLGK |
| hIgG4-DHS | 2159 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPSCPAPEFLGGPSVFLFPPKPKDTLMISRTPEVTCV VVDVSQEDPEVQFNWYVDGVEVHNAKTKPREEQFNSTYRVVSVLT VDHHDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHSYTQKSLSLSLG K |
| hIgG4-SP/DHS | 2160 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEFLGGPSVFLFPPKPKDTLMISRTPEVTCV VVDVSQEDPEVQFNWYVDGVEVHNAKTKPREEQFNSTYRVVSVLT VDHHDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHSYTQKSLSLSLG K |
| hIgG4-SPLE/DHS | 2161 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEELGGPSVFLFPPKPKDTLMISRTPEVTCV VVDVSQEDPEVQFNWYVDGVEVHNAKTKPREEQFNSTYRVVSVLT VDHHDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVMHEALHSYTQKSLSLSLG K |
| hIgG2-YTE | 2162 | ASTKGPSVFPLAPCSRSTSESTAALGCLVKDYFPEPVTVSWNSGALT SGVHTFPAVLQSSGLYSLSSVVTVPSSNFGTQTYTCNVDHKPSNTKV DKTVERKCCVECPPCPAPPVAGPSVFLFPPKPKDTLYITREPEVTCVV VDVSHEDPEVQFNWYVDGVEVHNAKTKPREEQFNSTFRVVSVLTV VHQDWLNGKEYKCKVSNKGLPAPIEKTISKTKGQPREPQVYTLPPSR EEMTKNQVSLTCLVKGFYPSDIAVEWESNGQPENNYKTTPPMLDSD GSFFLYSKLTVDKSRWQQGNVFSCSVLHEALHSYTQKSLSLSP |
| hIgG2-LS | 2163 | ASTKGPSVFPLAPCSRSTSESTAALGCLVKDYFPEPVTVSWNSGALT SGVHTFPAVLQSSGLYSLSSVVTVPSSNFGTQTYTCNVDHKPSNTKV DKTVERKCCVECPPCPAPPVAGPSVFLFPPKPKDTLMISRTPEVTCVV VDVSHEDPEVQFNWYVDGVEVHNAKTKPREEQFNSTFRVVSVLTV VHQDWLNGKEYKCKVSNKGLPAPIEKTISKTKGQPREPQVYTLPPSR EEMTKNQVSLTCLVKGFYPSDIAVEWESNGQPENNYKTTPPMLDSD GSFFLYSKLTVDKSRWQQGNVFSCSVMHEALHNHYTQKSLSLSP |
| hIgG2-DHS | 2164 | ASTKGPSVFPLAPCSRSTSESTAALGCLVKDYFPEPVTVSWNSGALT SGVHTFPAVLQSSGLYSLSSVVTVPSSNFGTQTYTCNVDHKPSNTKV DKTVERKCCVECPPCPAPPVAGPSVFLFPPKPKDTLMISRTPEVTCVV VDVSHEDPEVQFNWYVDGVEVHNAKTKPREEQFNSTFRVVSVLTV DHHDWLNGKEYKCKVSNKGLPAPIEKTISKTKGQPREPQVYTLPPSR |

TABLE 3-continued

| | | |
|---|---|---|

Fc Sequences

| Name | SEQ ID NO | Fc Sequence |
|---|---|---|
| | | EEMTKNQVSLTCLVKGFYPSDIAVEWESNGQPENNYKTTPPMLDSD<br>GSFFLYSKLTVDKSRWQQGNVFSCSVMHEALHSHYTQKSLSLSP |
| IgG4-SP | 2165 | ASTKGPSVFPLAPCSRSTSESTAALGCLVKDYFPEPVTVSWNSGALT<br>SGVHTFPAVLQSSGLYSLSSVVTVPSSSLGTKTYTCNVDHKPSNTKV<br>DKRVESKYGPPCPPCPAPEFLGGPSVFLFPPKPKDTLMISRTPEVTCV<br>VVDVSQEDPEVQFNWYVDGVEVHNAKTKPREEQFNSTYRVVSVLT<br>VLHQDWLNGKEYKCKVSNKGLPSSIEKTISKAKGQPREPQVYTLPPS<br>QEEMTKNQVSLTCLVKGFYPSDIAVEWESNGQPENNYKTTPVLDS<br>DGSFFLYSRLTVDKSRWQEGNVFSCSVMHEALHNHYTQKSLSLSLG<br>K |
| hIgG1-LA | 2166 | ASTKGPSVFPLAPSSKSTSGGTAALGCLVKDYFPEPVTVSWNSGALT<br>SGVHTFPAVLQSSGLYSLSSVVTVPSSSLGTQTYICNVNHKPSNTKV<br>DKKVEPKSCDKTHTCPPCPAPELLGGPSVFLFPPKPKDTLMISRTPEV<br>TCVVVDVSHEDPEVKFNWYVDGVEVHNAKTKPREEQYNSTYRVVS<br>VLTVLHQDWLNGKEYKCKVSNKALPAPIEKTISKAKGQPREPQVYT<br>LPPSRDELTKNQVSLTCLVKGFYPSDIAVEWESNGQPENNYKTTPPV<br>LDSDGSFFLYSKLTVDKSRWQQGNVFSCSVLHEALHAHYTQKSLSL<br>SPG |
| hIgG1-<br>N297A/LA | 2167 | ASTKGPSVFPLAPSSKSTSGGTAALGCLVKDYFPEPVTVSWNSGALT<br>SGVHTFPAVLQSSGLYSLSSVVTVPSSSLGTQTYICNVNHKPSNTKV<br>DKKVEPKSCDKTHTCPPCPAPELLGGPSVFLFPPKPKDTLMISRTPEV<br>TCVVVDVSHEDPEVKFNWYVDGVEVHNAKTKPREEQYASTYRVVS<br>VLTVLHQDWLNGKEYKCKVSNKALPAPIEKTISKAKGQPREPQVYT<br>LPPSRDELTKNQVSLTCLVKGFYPSDIAVEWESNGQPENNYKTTPPV<br>LDSDGSFFLYSKLTVDKSRWQQGNVFSCSVLHEALHAHYTQKSLSL<br>SPG |
| hIgG1-<br>D265A/LA | 2168 | ASTKGPSVFPLAPSSKSTSGGTAALGCLVKDYFPEPVTVSWNSGALT<br>SGVHTFPAVLQSSGLYSLSSVVTVPSSSLGTQTYICNVNHKPSNTKV<br>DKKVEPKSCDKTHTCPPCPAPELLGGPSVFLFPPKPKDTLMISRTPEV<br>TCVVVAVSHEDPEVKFNWYVDGVEVHNAKTKPREEQYNSTYRVVS<br>VLTVLHQDWLNGKEYKCKVSNKALPAPIEKTISKAKGQPREPQVYT<br>LPPSRDELTKNQVSLTCLVKGFYPSDIAVEWESNGQPENNYKTTPPV<br>LDSDGSFFLYSKLTVDKSRWQQGNVFSCSVLHEALHAHYTQKSLSL<br>SPG |
| hIgG1-<br>LALA/LA | 2169 | ASTKGPSVFPLAPSSKSTSGGTAALGCLVKDYFPEPVTVSWNSGALT<br>SGVHTFPAVLQSSGLYSLSSVVTVPSSSLGTQTYICNVNHKPSNTKV<br>DKKVEPKSCDKTHTCPPCPAPEAAGGPSVFLFPPKPKDTLMISRTPEV<br>TCVVVDVSHEDPEVKFNWYVDGVEVHNAKTKPREEQYNSTYRVVS<br>VLTVLHQDWLNGKEYKCKVSNKALPAPIEKTISKAKGQPREPQVYT<br>LPPSRDELTKNQVSLTCLVKGFYPSDIAVEWESNGQPENNYKTTPPV<br>LDSDGSFFLYSKLTVDKSRWQQGNVFSCSVLHEALHAHYTQKSLSL<br>SPG |
| hIgG1-<br>LAGA/LA | 2170 | ASTKGPSVFPLAPSSKSTSGGTAALGCLVKDYFPEPVTVSWNSGALT<br>SGVHTFPAVLQSSGLYSLSSVVTVPSSSLGTQTYICNVNHKPSNTKV<br>DKKVEPKSCDKTHTCPPCPAPELAGAPSVFLFPPKPKDTLMISRTPEV<br>TCVVVDVSHEDPEVKFNWYVDGVEVHNAKTKPREEQYNSTYRVVS<br>VLTVLHQDWLNGKEYKCKVSNKALPAPIEKTISKAKGQPREPQVYT<br>LPPSRDELTKNQVSLTCLVKGFYPSDIAVEWESNGQPENNYKTTPPV<br>LDSDGSFFLYSKLTVDKSRWQQGNVFSCSVLHEALHAHYTQKSLSL<br>SPG |
| hIgG1-<br>LALAGA/LA | 2171 | ASTKGPSVFPLAPSSKSTSGGTAALGCLVKDYFPEPVTVSWNSGALT<br>SGVHTFPAVLQSSGLYSLSSVVTVPSSSLGTQTYICNVNHKPSNTKV<br>DKKVEPKSCDKTHTCPPCPAPEAAGAPSVFLFPPKPKDTLMISRTPEV<br>TCVVVDVSHEDPEVKFNWYVDGVEVHNAKTKPREEQYNSTYRVVS<br>VLTVLHQDWLNGKEYKCKVSNKALPAPIEKTISKAKGQPREPQVYT<br>LPPSRDELTKNQVSLTCLVKGFYPSDIAVEWESNGQPENNYKTTPPV<br>LDSDGSFFLYSKLTVDKSRWQQGNVFSCSVLHEALHAHYTQKSLSL<br>SPG |
| hIgG1-<br>LALAPG/LA | 2172 | ASTKGPSVFPLAPSSKSTSGGTAALGCLVKDYFPEPVTVSWNSGALT<br>SGVHTFPAVLQSSGLYSLSSVVTVPSSSLGTQTYICNVNHKPSNTKV<br>DKKVEPKSCDKTHTCPPCPAPEAAGGPSVFLFPPKPKDTLMISRTPEV<br>TCVVVDVSHEDPEVKFNWYVDGVEVHNAKTKPREEQYNSTYRVVS<br>VLTVLHQDWLNGKEYKCKVSNKALGAPIEKTISKAKGQPREPQVYT<br>LPPSRDELTKNQVSLTCLVKGFYPSDIAVEWESNGQPENNYKTTPPV<br>LDSDGSFFLYSKLTVDKSRWQQGNVFSCSVLHEALHAHYTQKSLSL<br>SPG |

TABLE 3-continued

| | | Fc Sequences |
|---|---|---|
| Name | SEQ ID NO | Fc Sequence |
| hIgG1-N434A | 2173 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHAHYTQKSLSL SPG |
| hIgG1-N297A/ N434A | 2174 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYASTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHAHYTQKSLSL SPG |
| hIgG1-D265A/ N434A | 2175 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVAVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHAHYTQKSLSL SPG |
| hIgG1-LALA/ N434A | 2176 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHAHYTQKSLSL SPG |
| hIgG1-LAGA/ N434A | 2177 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHAHYTQKSLSL SPG |
| hIgG1-LALAGA/ N434A | 2178 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHAHYTQKSLSL SPG |
| hIgG1-LALAPG/ N434A | 2179 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALGAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHAHYTQKSLSL SPG |
| hIgG1-N434W | 2180 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHWHYTQKSLS LSPG |

TABLE 3-continued

| | | Fc Sequences |
|---|---|---|
| Name | SEQ ID NO | Fc Sequence |
| hIgG1-N297A/N434W | 2181 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYASTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHWHYTQKSLS LSPG |
| hIgG1-D265A/N434W | 2182 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVAVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHWHYTQKSLS LSPG |
| hIgG1-LALA/N434W | 2183 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHWHYTQKSLS LSPG |
| hIgG1-LAGA/N434W | 2184 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHWHYTQKSLS LSPG |
| hIgG1-LALAGA/N434W | 2185 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHWHYTQKSLS LSPG |
| hIgG1-LALAPG/N434W | 2186 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALGAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHWHYTQKSLS LSPG |
| hIgG1/DQ | 2187 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVDVSHEDPEVKFNWYVDGVEVHNAKTKPREEQYNSTYRVVS VLQVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-N297A/DQ | 2188 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVDVSHEDPEVKFNWYVDGVEVHNAKTKPREEQYASTYRVVS VLQVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |

TABLE 3-continued

| | | Fc Sequences |
|---|---|---|
| Name | SEQ ID NO | Fc Sequence |
| hIgG1-D265A/DQ | 2189 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVAVSHEDPEVKFNWYVDGVEVHNAKTKPREEQYNSTYRVVS VLQVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALA/DQ | 2190 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRDPE VTCVVVDVSHEDPEVKFNWYVDGVEVHNAKTKPREEQYNSTYRV VSVLQVLHQDWLNGKEYKCKVSNKALPAPIEKTISKAKGQPREPQV YTLPPSRDELTKNQVSLTCLVKGFYPSDIAVEWESNGQPENNYKTTP PVLDSDGSFFLYSKLTVDKSRWQQGNVFSCSVMHEALHNHYTQKSL SLSPG |
| hIgG1-LAGA/DQ | 2191 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRDPEV TCVVVDVSHEDPEVKFNWYVDGVEVHNAKTKPREEQYNSTYRVVS VLQVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALAGA/DQ | 2192 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRDPE VTCVVVDVSHEDPEVKFNWYVDGVEVHNAKTKPREEQYNSTYRV VSVLQVLHQDWLNGKEYKCKVSNKALPAPIEKTISKAKGQPREPQV YTLPPSRDELTKNQVSLTCLVKGFYPSDIAVEWESNGQPENNYKTTP PVLDSDGSFFLYSKLTVDKSRWQQGNVFSCSVMHEALHNHYTQKSL SLSPG |
| hIgG1-LALAPG/DQ | 2193 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRDPE VTCVVVDVSHEDPEVKFNWYVDGVEVHNAKTKPREEQYNSTYRV VSVLQVLHQDWLNGKEYKCKVSNKALGAPIEKTISKAKGQPREPQV YTLPPSRDELTKNQVSLTCLVKGFYPSDIAVEWESNGQPENNYKTTP PVLDSDGSFFLYSKLTVDKSRWQQGNVFSCSVMHEALHNHYTQKSL SLSPG |
| hIgG1/DW | 2194 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVDVSHEDPEVKFNWYVDGVEVHNAKTKPREEQYNSTYRVVS VLWVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-N297A/DW | 2195 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVDVSHEDPEVKFNWYVDGVEVHNAKTKPREEQYASTYRVVS VLWVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-D265A/DW | 2196 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVAVSHEDPEVKFNWYVDGVEVHNAKTKPREEQYNSTYRVVS VLWVLHQDWLNGKEYKCKVSNKALPAPIEKTISKAKGQPREPQVYT LPPSRDELTKNQVSLTCLVKGFYPSDIAVEWESNGQPENNYKTTPPV |

TABLE 3-continued

| | | |
|---|---|---|
| | | Fc Sequences |

| Name | SEQ ID NO | Fc Sequence |
|---|---|---|
| | | LDSDGSFFLYSKLTVDKSRWQQGNVFSCSVMHEALHNHYTQKSLSL SPG |
| hIgG1-LALA/DW | 2197 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRDPE VTCVVVDVSHEDPEVKFNWYVDGVEVHNAKTKPREEQYNSTYRV VSVLWVLHQDWLNGKEYKCKVSNKALPAPIEKTISKAKGQPREPQV YTLPPSRDELTKNQVSLTCLVKGFYPSDIAVEWESNGQPENNYKTTP PVLDSDGSFFLYSKLTVDKSRWQQGNVFSCSVMHEALHNHYTQKSL SLSPG |
| hIgG1-LAGA/DW | 2198 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRDPEV TCVVVDVSHEDPEVKFNWYVDGVEVHNAKTKPREEQYNSTYRVVS VLWVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALAGA/DW | 2199 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRDPE VTCVVVDVSHEDPEVKFNWYVDGVEVHNAKTKPREEQYNSTYRV VSVLWVLHQDWLNGKEYKCKVSNKALPAPIEKTISKAKGQPREPQV YTLPPSRDELTKNQVSLTCLVKGFYPSDIAVEWESNGQPENNYKTTP PVLDSDGSFFLYSKLTVDKSRWQQGNVFSCSVMHEALHNHYTQKSL SLSPG |
| hIgG1-LALAPG/DW | 2200 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRDPE VTCVVVDVSHEDPEVKFNWYVDGVEVHNAKTKPREEQYNSTYRV VSVLWVLHQDWLNGKEYKCKVSNKALGAPIEKTISKAKGQPREPQ VYTLPPSRDELTKNQVSLTCLVKGFYPSDIAVEWESNGQPENNYKTT PPVLDSDGSFFLYSKLTVDKSRWQQGNVFSCSVMHEALHNHYTQKS LSLSPG |
| hIgG1/YD | 2201 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLYISRDPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-N297A/YD | 2202 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLYISRDPEV TCVVVDVSHEDPEVKFNWYVDGVEVHNAKTKPREEQYASTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-D265A/YD | 2203 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLYISRDPEV TCVVVAVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALA/YD | 2204 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLYISRDPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |

TABLE 3-continued

| | SEQ ID NO | |
|---|---|---|
Fc Sequences

| Name | SEQ ID NO | Fc Sequence |
|---|---|---|
| hIgG1-LAGA/YD | 2205 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLYISRDPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALAGA/YD | 2206 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLYISRDPEV TCVVVDVSHEDPEVKFNWYVDGVEVHNAKTKPREEQYNSTYRVVS VLTVLHQDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1-LALAPG/YD | 2207 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLYISRDPEV TCVVVDVSHEDPEVKFNWYVDGVEVHNAKTKPREEQYNSTYRVVS VLTVLHQDWLNGKEYKCKVSNKALGAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVMHEALHNHYTQKSLSL SPG |
| hIgG1/QVV | 2208 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYNSTYRVVS VLQVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-N297A/QVV | 2209 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYASTYRVVS VLQVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-D265A/QVV | 2210 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVAVSHEDPEVKFNWYVDGVEVHNAKTKPREEQYNSTYRVVS VLQVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-LALA/QVV | 2211 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLQVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-LAGA/QVV | 2212 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRTPEV TCVVVDVSHEDPEVKFNWYVDGVEVHNAKTKPREEQYNSTYRVVS VLQVLHVDWLNGKEYKCKVSNKALPAPIEKTISKAKGQPREPQVYT LPPSRDELTKNQVSLTCLVKGFYPSDIVVEWESNGQPENNYKTTPPV |

TABLE 3-continued

| | | |
|---|---|---|
| | | Fc Sequences |

| Name | SEQ ID NO | Fc Sequence |
|---|---|---|
| | | LDSDGSFFLYSKLTVDKSRWQQGNVFSCSVMHEALHNHYTQKSLSL SPG |
| hIgG1-LALAGA/QVV | 2213 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRTPEV TCVVVDVSHEDPEVKFNWYVDGVEVHNAKTKPREEQYNSTYRVVS VLQVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-LALAPG/QVV | 2214 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRTPEV TCVVVDVSHEDPEVKFNWYVDGVEVHNAKTKPREEQYNSTYRVVS VLQVLHVDWLNGKEYKCKVSNKALGAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1/DDRVV | 2215 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVDVSHEDPEVKFNWYVDGVEVDNAKTKPREEQYNSTYRVVS VLRVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-N297A/DDRVV | 2216 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVDVSHEDPEVKFNWYVDGVEVDNAKTKPREEQYASTYRVVS VLRVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-D265A/DDRVV | 2217 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRDPEV TCVVVAVSHEDPEVKFNWYVDGVEVDNAKTKPREEQYNSTYRVVS VLRVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-LALA/DDRVV | 2218 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRDPE VTCVVVDVSHEDPEVKFNWYVDGVEVDNAKTKPREEQYNSTYRV VSVLRVLHVDWLNGKEYKCKVSNKALPAPIEKTISKAKGQPREPQV YTLPPSRDELTKNQVSLTCLVKGFYPSDIVVEWESNGQPENNYKTTP PVLDSDGSFFLYSKLTVDKSRWQQGNVFSCSVMHEALHNHYTQKSL SLSPG |
| hIgG1-LAGA/DDRVV | 2219 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELAGAPSVFLFPPKPKDTLMISRDPEV TCVVVDVSHEDPEVKFNWYVDGVEVDNAKTKPREEQYNSTYRVVS VLRVLHVDWLNGKEYKCKVSNKALPAPIEKTISKAKGQPREPQVYT LPPSRDELTKNQVSLTCLVKGFYPSDIVVEWESNGQPENNYKTTPPV LDSDGSFFLYSKLTVDKSRWQQGNVFSCSVMHEALHNHYTQKSLSL SPG |
| hIgG1-LALAGA/DDRVV | 2220 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGAPSVFLFPPKPKDTLMISRDPE VTCVVVDVSHEDPEVKFNWYVDGVEVDNAKTKPREEQYNSTYRV VSVLRVLHVDWLNGKEYKCKVSNKALPAPIEKTISKAKGQPREPQV YTLPPSRDELTKNQVSLTCLVKGFYPSDIVVEWESNGQPENNYKTTP PVLDSDGSFFLYSKLTVDKSRWQQGNVFSCSVMHEALHNHYTQKSL SLSPG |

TABLE 3-continued

| | | Fc Sequences |
|---|---|---|

| Name | SEQ ID NO | Fc Sequence |
|---|---|---|
| hIgG1-LALAPG/DDRVV | 2221 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPEAAGGPSVFLFPPKPKDTLMISRDPE VTCVVVDVSHEDPEVKFNWYVDGVEVDNAKTKPREEQYNSTYRV VSVLRVLHVDWLNGKEYKCKVSNKALGAPIEKTISKAKGQPREPQV YTLPPSRDELTKNQVSLTCLVKGFYPSDIVVEWESNGQPENNYKTTP PVLDSDGSFFLYSKLTVDKSRWQQGNVFSCSVMHEALHNHYTQKSL SLSPG |
| hIgG1-Q311R/M428L | 2222 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYNSTYRVVS VLTVLHRDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHNHYTQKSLSL SPG |
| hIgG4-Q311R/M428L | 2223 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPSCPAPEFLGGPSVFLFPPKPKDTLMISRTPEVTCV VVDVSQEDPEVQFNWYVDGVEVHNAKTKPREEQFNSTYRVVSVLT VLHRDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVLHEALHNHYTQKSLSLSLG K |
| IgG4-SP/Q311R/M428L | 2224 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEFLGGPSVFLFPPKPKDTLMISRTPEVTCV VVDVSQEDPEVQFNWYVDGVEVHNAKTKPREEQFNSTYRVVSVLT VLHRDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVLHEALHNHYTQKSLSLSLG K |
| IgG4-SPLE/Q311R/M428L | 2225 | ASTKGPSVFPLAPCSRSTSESTAALGCLVKDYFPEPVTVSWNSGALT SGVHTFPAVLQSSGLYSLSSVVTVPSSSLGTKTYTCNVDHKPSNTKV DKRVESKYGPPCPPCPAPEELGGPSVFLFPPKPKDTLMISRTPEVTCV VVDVSQEDPEVQFNWYVDGVEVHNAKTKPREEQFNSTYRVVSVLT VLHRDWLNGKEYKCKVSNKGLPSSIEKTISKAKGQPREPQVYTLPPS QEEMTKNQVSLTCLVKGFYPSDIAVEWESNGQPENNYKTTPPVLDS DGSFFLYSRLTVDKSRWQEGNVFSCSVLHEALHNHYTQKSLSLSLG K |
| IgG2-Q311R/M428L | 2226 | ASTKGPSVFPLAPCSRSTSESTAALGCLVKDYFPEPVTVSWNSGALT SGVHTFPAVLQSSGLYSLSSVVTVPSSNFGTQTYTCNVDHKPSNTKV DKTVERKCCVECPPCPAPPVAGPSVFLFPPKPKDTLMISRTPEVTCVV VDVSHEDPEVQFNWYVDGVEVHNAKTKPREEQFNSTFRVVSVLTV VHRDWLNGKEYKCKVSNKGLPAPIEKTISKTKGQPREPQVYTLPPSR EEMTKNQVSLTCLVKGFYPSDIAVEWESNGQPENNYKTTPPMLDSD GSFFLYSKLTVDKSRWQQGNVFSCSVLHEALHNHYTQKSLSLSP |
| hIgG1-N297A/Q311R/M428L | 2227 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVDVSHEDPEVKFNWYVDGVEVHNAKTKPREEQYASTYRVVS VLTVLHRDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHNHYTQKSLSL SPG |
| hIgG1-D265A/Q311R/M428L | 2228 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV DKKVEPKSCDKTHTCPPCPAPELLGGPSVFLFPPKPKDTLMISRTPEV TCVVVAVSHEDPEVKFNWYVDGVEVHNAKTKPREEQYNSTYRVVS VLTVLHRDWLNGKEYKCKVSNKALPAPIEKTISKAKGQPREPQVYT LPPSRDELTKNQVSLTCLVKGFYPSDIAVEWESNGQPENNYKTTPPV LDSDGSFFLYSKLTVDKSRWQQGNVFSCSVLHEALHNHYTQKSLSL SPG |
| hIgG1-LALA/Q311R/ | 2229 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKV |

TABLE 3-continued

Fc Sequences

| Name | SEQ ID NO | Fc Sequence |
|------|-----------|-------------|
| M428L | | DKKVEPKSCDKTHTCPPCPAPEAAGGPSVFLFPPKPKDTLMISRTPEV |
| | | TCVVVDVSHEDPEVKFNWYVDGVEVHNAKTKPREEQYNSTYRVVS |
| | | VLTVLHRDWLNGKEYKCKVSNKALPAPIEKTISKAKGQPREPQVYT |
| | | LPPSRDELTKNQVSLTCLVKGFYPSDIAVEWESNGQPENNYKTTPPV |
| | | LDSDGSFFLYSKLTVDKSRWQQGNVFSCSVLHEALHNHYTQKSLSL |
| | | SPG |
| hIgG1-LAGA/Q311R/M428L | 2230 | ASTKGPSVFPLAPSSKSTSGGTAALGCLVKDYFPEPVTVSWNSGALT |
| | | SGVHTFPAVLQSSGLYSLSSVVTVPSSSLGTQTYICNVNHKPSNTKV |
| | | DKKVEPKSCDKTHTCPPCPAPELAGAPSVFLFPPKPKDTLMISRTPEV |
| | | TCVVVDVSHEDPEVKFNWYVDGVEVHNAKTKPREEQYNSTYRVVS |
| | | VLTVLHRDWLNGKEYKCKVSNKALPAPIEKTISKAKGQPREPQVYT |
| | | LPPSRDELTKNQVSLTCLVKGFYPSDIAVEWESNGQPENNYKTTPPV |
| | | LDSDGSFFLYSKLTVDKSRWQQGNVFSCSVLHEALHNHYTQKSLSL |
| | | SPG |
| hIgG1-LALAGA/Q311R/M428L | 2231 | ASTKGPSVFPLAPSSKSTSGGTAALGCLVKDYFPEPVTVSWNSGALT |
| | | SGVHTFPAVLQSSGLYSLSSVVTVPSSSLGTQTYICNVNHKPSNTKV |
| | | DKKVEPKSCDKTHTCPPCPAPEAAGAPSVFLFPPKPKDTLMISRTPEV |
| | | TCVVVDVSHEDPEVKFNWYVDGVEVHNAKTKPREEQYNSTYRVVS |
| | | VLTVLHRDWLNGKEYKCKVSNKALPAPIEKTISKAKGQPREPQVYT |
| | | LPPSRDELTKNQVSLTCLVKGFYPSDIAVEWESNGQPENNYKTTPPV |
| | | LDSDGSFFLYSKLTVDKSRWQQGNVFSCSVLHEALHNHYTQKSLSL |
| | | SPG |
| hIgG1-LALAPG/Q311R/M428L | 2232 | ASTKGPSVFPLAPSSKSTSGGTAALGCLVKDYFPEPVTVSWNSGALT |
| | | SGVHTFPAVLQSSGLYSLSSVVTVPSSSLGTQTYICNVNHKPSNTKV |
| | | DKKVEPKSCDKTHTCPPCPAPEAAGGPSVFLFPPKPKDTLMISRTPEV |
| | | TCVVVDVSHEDPEVKFNWYVDGVEVHNAKTKPREEQYNSTYRVVS |
| | | VLTVLHRDWLNGKEYKCKVSNKALGAPIEKTISKAKGQPREPQVYT |
| | | LPPSRDELTKNQVSLTCLVKGFYPSDIAVEWESNGQPENNYKTTPPV |
| | | LDSDGSFFLYSKLTVDKSRWQQGNVFSCSVLHEALHNHYTQKSLSL |
| | | SPG |

In some embodiments, the α4β7 integrin binding protein comprises a Fc, wherein the Fc has an amino acid sequence with a terminal Lysine as compared to any one of SEQ ID NO: 2121, 2123, 2126-2152, 2162-2164, 2166-2222, 2226-2232. In some embodiments, the α4β7 integrin binding protein comprises a Fc, wherein the Fc has an amino acid sequence that lacks a terminal Lysine as compared to any one of SEQ ID NO: 2122, 2124, 2125, 2153-2161, 2165, 2223-2225.

In some embodiments, the α4β7 integrin binding protein comprises a Fc comprising one or more modifications in SEQ ID NO: 2121. In some embodiments, the α4β7 integrin binding protein comprises a Fc comprising one or more modifications in SEQ ID NO: 2122. In some embodiments, the α4β7 integrin binding protein comprises a Fc comprising one or more modifications in SEQ ID NO: 2123. In some embodiments, the Fc comprises an amino acid sequence having at least 80% sequence identity with the amino acid sequence according to any one of SEQ ID NOs: 2121-2123. In some embodiments, the Fc comprises an amino acid sequence having at least 85% sequence identity with the amino acid sequence according to any one of SEQ ID NOs: 2121-2123. In some embodiments, the Fc comprises an amino acid sequence having at least 90% sequence identity with the amino acid sequence according to any one of SEQ ID NOs: 2121-2123. In some embodiments, the Fc comprises an amino acid sequence having at least 95% sequence identity with the amino acid sequence according to any one of SEQ ID NOs: 2121-2123. In some embodiments, the Fc comprises an amino acid sequence having at least 96% sequence identity with the amino acid sequence according to any one of SEQ ID NOs: 2121-2123. In some embodiments, the Fc comprises an amino acid sequence having at least 97% sequence identity with the amino acid sequence according to any one of SEQ ID NOs: 2121-2123. In some embodiments, the Fc comprises an amino acid sequence having at least 98% sequence identity with the amino acid sequence according to any one of SEQ ID NOs: 2121-2123. In some embodiments, the Fc comprises an amino acid sequence having at least 99% sequence identity with the amino acid sequence according to any one of SEQ ID NOs: 2121-2123. In some embodiments, the Fc comprises the amino acid sequence according to any one of SEQ ID NOs: 2121-2123.

In some embodiments, one or more modifications in the modified Fc is selected from the group consisting of: S298A, E333A, K334A, K326A, F243L, R292P, Y300L, V305I, P396L, F243L, R292P, Y300L, L235V, P396L, F243L, S239D, I332E, A330L, S267E, L328F, D265S, S239E, K326A, A327H, G237F, K326E, G236A, D270L, H268D, S324T, L234F, N325L, V266L, and S267D. In some embodiments, one or more modifications in the modified Fc is selected from the group consisting of S228P, M252Y, S254T, T256E, T256D, T250Q, H285D, T307A, T307Q, T307R, T307W, L309D, Q411H, Q311V, A378V, E380A, M428L, N434A, N434S, N297A, D265A, L234A, L235A, and N434W.

In some embodiments, the modified Fc comprises a specific combination of amino acid substitutions selected from the group consisting of: L234A/L235A; V234A/G237A; L235A/G237A/E318A; S228P/L236E; H268QN309L/A330S/A331S; C220S/C226S/C229S/

P238S; C226S/C229S/E3233P/L235V/L235A; L234F/ L235E/P331S; C226S/P230S; L234A/G237A; L234A/ L235A/G237A; Q311R/M428L; and L234A/L235A/ P329G.

In some embodiments, the modified Fc comprises a specific combination of amino acid substitutions selected from the group consisting of M428L/N434S (LS); M252Y/ S254T/T256E (YTE); T250Q/M428L; T307A/E380A/ N434A; T256D/T307Q (DQ); T256D/T307W (DW); M252Y/T256D (YD); T307Q/Q311V/A378V (QVV); T256D/H285D/T307R/Q311V/A378V (DDRVV); L309D/ Q311H/N434S (DHS); S228P/L235E (SPLE); L234A/ L235A (LALA); M428L/N434A (LA); L234A/G237A (LAGA); L234A/L235A/G237A (LALAGA); L234A/ L235A/P329G (LALAPG); N297A/YTE; D265A/YTE; LALA/YTE; LAGA/YTE; LALAGA/YTE; LALAPG/ YTE; N297A/LS; D265A/LS; LALA/LS; LAGA/LS; LALAGA/LS; LALAPG/LS; N297A/DHS; D265A/DHS; LALA/DHS; LAGA/DHS; LALAGA/DHS; LALAPG/ DHS; SP/YTE; SPLE/YTE; SP/LS; SPLE/LS; SP/DHS; SPLE/DHS; N297A/LA; D265A/LA; LALA/LA; LAGA/ LA; LALAGA/LA; LALAPG/LA; N297A/N434A; D265A/ N434A; LALA/N434A; LAGA/N434A; LALAGA/N434A; LALAPG/N434A; N297A/N434W; D265A/N434W; LALA/N434W; LAGA/N434W; LALAGA/N434W; LALAPG/N434W; N297A/DQ; D265A/DQ; LALA/DQ; LAGA/DQ; LALAGA/DQ; LALAPG/DQ; N297A/DW; D265A/DW; LALA/DW; LAGA/DW; LALAGA/DW; LALAPG/DW; N297A/YD; D265A/YD; LALA/YD; LAGA/YD; LALAGA/YD; LALAPG/YD; N297A/QVV; D265A/QVV; LALA/QVV; LAGA/QVV, LALAGA/QVV; LALAPG/QVV; N297A/DDRVV; D265A/DDRVV; LALA/ DDRVV; LAGA/DDRVV; LALAGA/DDRVV; LALAPG/ DDRVV; SP/Q311R/M428L; SPLE/Q311R/M428L; N297A/Q311R/M428L; D265A/Q311R/M428L; LALA/ Q311R/M428L; LAGA/Q311R/M428L; LALAGA/Q311R/ M428L; and LALAPG/Q311R/M428L. In some embodiments, the modified Fc comprises a specific combination of amino acid substitutions selected from the group consisting of M428L/N434S (LS) and M252Y/S254T/T256E (YTE). In some embodiments, the modified Fc comprises M428L/ N434S (LS) (e.g., SEQ ID NO: 2139, SEQ ID NO: 2156, SEQ ID NO: 2163) modifications. In some embodiments, the modified Fc comprises M252Y/S254T/T256E (YTE) (e.g., SEQ ID NO: 2132, SEQ ID NO: 2153, SEQ ID NO: 2162) modifications.

In some embodiments, the α4β7 integrin binding proteins described herein include modifications to improve its ability to mediate effector function. Such modifications are known in the art and include afucosylation, or engineering of the affinity of the Fc towards an activating receptor, mainly FCGR3a for antibody-dependent cellular cytotoxicity (ADCC), and towards C1q for complement-dependent cytotoxicity (CDC).

In some aspects, an antibody provided herein comprises a Fc domain (e.g., IgG1) with reduced fucose content at position Asn 297 (EU numbering) compared to a naturally occurring Fc domain. Such Fc domains are known to have improved ADCC. In some aspects, such antibodies do not comprise any fucose at position Asn 297.

In some embodiments, the α4β7 integrin binding proteins described herein comprise an Fc region with one or more amino acid substitutions which improve ADCC, such as a substitution at one or more of positions 298, 333, and 334 of the Fc region. In some embodiments, an antibody provided herein comprises an Fc region with one or more amino acid substitutions at positions 239, 332, and 330.

In some embodiments, the Fc comprises an amino acid sequence having at least 80% sequence identity with the amino acid sequence according to any one of SEQ ID NOs: 2124-2232. In some embodiments, the Fc comprises an amino acid sequence having at least 85% sequence identity with the amino acid sequence according to any one of SEQ ID NOs: 2124-2232. In some embodiments, the Fc comprises an amino acid sequence having at least 90% sequence identity with the amino acid sequence according to any one of SEQ ID NOs: 2124-2232. In some embodiments, the Fc comprises an amino acid sequence having at least 95% sequence identity with the amino acid sequence according to any one of SEQ ID NOs: 2124-2232. In some embodiments, the Fc comprises an amino acid sequence having at least 96% sequence identity with the amino acid sequence according to any one of SEQ ID NOs: 2124-2232. In some embodiments, the Fc comprises an amino acid sequence having at least 97% sequence identity with the amino acid sequence according to any one of SEQ ID NOs: 2124-2232. In some embodiments, the Fc comprises an amino acid sequence having at least 98% sequence identity with the amino acid sequence according to any one of SEQ ID NOs: 2124-2232. In some embodiments, the Fc comprises an amino acid sequence having at least 99% sequence identity with the amino acid sequence according to any one of SEQ ID NOs: 2124-2232. In some embodiments, the Fc comprises the amino acid sequence according to any one of SEQ ID NOs: 2124-2232.

In some embodiments, the α4β7 integrin binding proteins described herein comprise an Fc region with at least one galactose residue in the oligosaccharide attached to the Fc region. Such antibody variants may have improved CDC function.

In some embodiments, the α4β7 integrin binding proteins described herein comprise one or more alterations that improve or diminish C1q binding and/or CDC.

In certain embodiments, the Fc region comprises one or more amino acid substitutions, wherein the one or more substitutions result in an increase in one or more of antibody half-life, ADCC activity, ADCP activity, or CDC activity compared with the Fc without the one or more substitutions. In certain embodiments, the one or more amino acid substitutions results in increased antibody half-life at pH 6.0 compared to an antibody comprising a wild-type Fc region. In certain embodiments, the antibody has an increased half-life that is about 10,000-fold, 1,000-fold, 500-fold, 100-fold, 50-fold, 20-fold, 10-fold, 9-fold, 8-fold, 7-fold, 6-fold, 5-fold, 4.5-fold, 4-fold, 3.5-fold, 3-fold, 2.5-fold, 2-fold, 1.95-fold, 1.9-fold, 1.85-fold, 1.8-fold, 1.75-fold, 1.7-fold, 1.65-fold, 1.6-fold, 1.55-fold, 1.50-fold, 1.45-fold, 1.4-fold, 1.35-fold, 1.3-fold, 1.25-fold, 1.2-fold, 1.15-fold, 1.1-fold, or 1.05-fold longer compared to an antibody comprising a wild-type Fc region.

In certain embodiments, the Fc region comprises one or more amino acid substitutions, wherein the one or more substitutions result in a decrease in one or more of ADCC activity, ADCP activity, or CDC activity compared with the Fc without the one or more substitutions.

In certain embodiments, the Fc region binds an Fcγ Receptor selected from the group consisting of: FcγRI, FcγRIIa, FcγRIIb, FcγRIIc, FcγRIIIa, and FcγRIIIb. In certain embodiments, the Fc region binds an Fcγ Receptor with higher affinity at pH 6.0 compared to an antibody comprising a wild-type Fc region.

In some embodiments, the α4β7 integrin binding proteins described herein comprise an extended half-life (i.e., serum half-life). In some embodiments, the α4β7 integrin binding proteins described herein comprise a half-life of at least about 14, 28, 42, 56, 70, 84, 96, or more than 96 weeks. In some embodiments, the α4β7 integrin binding proteins described herein comprise a half-life in a range of about 14 days to about 96 days, about 14 days to about 84 days, about 14 days to about 70 days, about 14 days to about 56 days, about 14 days to about 42 days, about 14 days to about 28 days, of about 28 days to about 96 days, about 28 days to about 84 days, about 28 days to about 70 days, about 28 days to about 56 days, about 28 days to about 42 days, of about 42 days to about 96 days, about 42 days to about 84 days, about 42 days to about 70 days, about 42 days to about 56 days, of about 56 days to about 96 days, about 56 days to about 84 days, about 56 days to about 70 days, of about 70 days to about 96 days, about 70 days to about 84 days, or of about 84 days to about 96 days. In some embodiments, the α4β7 integrin binding proteins described herein comprise a half-life in a range of about 42 days to about 56 days. In some embodiments, the α4β7 integrin binding proteins described herein comprise a half-life of at least about 50 days. In some embodiments, the α4β7 integrin binding proteins described herein comprise a half-life of about 50 days. Methods of measuring half-life are known in the art. In some embodiments, the half-life is measured in a non-human primate. In some embodiments, the half-life is measured in a human. In some embodiments, the half-life is measured following intravenous administration. In some embodiments, the half-life is measured following subcutaneous administration.

In some embodiments, the α4β7 integrin binding proteins described herein have a half-life that is at least 20% longer than a comparator antibody. In some embodiments, the comparator antibody comprises the same complementarity determining regions and variable regions but different Fc regions. In some embodiments, the half-life of the α4β7 integrin binding proteins described herein is at least 30%, at least 40%, at least 50%, at least 60%, at least 70%, at least 80%, or at least 90% longer than the half-life of the comparator antibody. In some embodiments, the half-life of the α4β7 integrin binding proteins described herein is longer than the half-life of the comparator antibody by at least 2 fold, at least 3 fold, at least 4 fold, at least 5 fold, at least 6 fold, at least 7 fold, at least 8 fold, at least 9 fold, or at least 10 fold.

Methods of Treatment

Described herein, in certain embodiments, are methods of treating an inflammatory bowel disease in a patient in need thereof, the method comprising subcutaneously or intravenously administering to the patient an effective amount of an α4β7 integrin binding protein comprising: a) a heavy chain variable region (VH) comprising (i) a CDR1 having an amino acid sequence according to SEQ ID NO: 3, (ii) a CDR2 having an amino acid sequence according to SEQ ID NO: 109, and (iii) a CDR3 having an amino acid sequence according to SEQ ID NO: 215; and a light chain variable region (VL) comprising (i) a CDR1 having an amino acid sequence according to SEQ ID NO: 321, (ii) a CDR2 having an amino acid sequence according to SEQ ID NO: 427, and (iii) a CDR3 having an amino acid sequence according to SEQ ID NO: 533; b) a heavy chain variable region (VH) comprising (i) a CDR1 having an amino acid sequence according to SEQ ID NO: 4, (ii) a CDR2 having an amino acid sequence according to SEQ ID NO: 110, and (iii) a CDR3 having an amino acid sequence according to SEQ ID NO: 216; and a light chain variable region (VL) comprising (i) a CDR1 having an amino acid sequence according to SEQ ID NO: 322, (ii) a CDR2 having an amino acid sequence according to SEQ ID NO: 428, and (iii) a CDR3 having an amino acid sequence according to SEQ ID NO: 534; c) a heavy chain variable region (VH) comprising (i) a CDR1 having an amino acid sequence according to SEQ ID NO: 5, (ii) a CDR2 having an amino acid sequence according to SEQ ID NO: 111, and (iii) a CDR3 having an amino acid sequence according to SEQ ID NO: 217; and a light chain variable region (VL) comprising (i) a CDR1 having an amino acid sequence according to SEQ ID NO: 323, (ii) a CDR2 having an amino acid sequence according to SEQ ID NO: 429, and (iii) a CDR3 having an amino acid sequence according to SEQ ID NO: 535; d) a heavy chain variable region (VH) comprising (i) a CDR1 having an amino acid sequence according to SEQ ID NO: 6, (ii) a CDR2 having an amino acid sequence according to SEQ ID NO: 112, and (iii) a CDR3 having an amino acid sequence according to SEQ ID NO: 218; and a light chain variable region (VL) comprising (i) a CDR1 having an amino acid sequence according to SEQ ID NO: 324, (ii) a CDR2 having an amino acid sequence according to SEQ ID NO: 430, and (iii) a CDR3 having an amino acid sequence according to SEQ ID NO: 536; e) a heavy chain variable region (VH) comprising (i) a CDR1 having an amino acid sequence according to SEQ ID NO: 81, (ii) a CDR2 having an amino acid sequence according to SEQ ID NO: 187, and (iii) a CDR3 having an amino acid sequence according to SEQ ID NO: 293; and a light chain variable region (VL) comprising (i) a CDR1 having an amino acid sequence according to SEQ ID NO: 399, (ii) a CDR2 having an amino acid sequence according to SEQ ID NO: 505, and (iii) a CDR3 having an amino acid sequence according to SEQ ID NO: 611; f) a heavy chain variable region (VH) comprising (i) a CDR1 having an amino acid sequence according to SEQ ID NO: 82, (ii) a CDR2 having an amino acid sequence according to SEQ ID NO: 188, and (iii) a CDR3 having an amino acid sequence according to SEQ ID NO: 294; and a light chain variable region (VL) comprising (i) a CDR1 having an amino acid sequence according to SEQ ID NO: 400, (ii) a CDR2 having an amino acid sequence according to SEQ ID NO: 506, and (iii) a CDR3 having an amino acid sequence according to SEQ ID NO: 612; or g) a heavy chain variable region (VH) comprising (i) a CDR1 having an amino acid sequence according to SEQ ID NO: 83, (ii) a CDR2 having an amino acid sequence according to SEQ ID NO: 189, and (iii) a CDR3 having an amino acid sequence according to SEQ ID NO: 295; and a light chain variable region (VL) comprising (i) a CDR1 having an amino acid sequence according to SEQ ID NO: 401, (ii) a CDR2 having an amino acid sequence according to SEQ ID NO: 507, and (iii) a CDR3 having an amino acid sequence according to SEQ ID NO: 613.

Further described herein, in certain embodiments, are methods of treating an inflammatory bowel disease in a patient in need thereof, the method comprising subcutaneously or intravenously administering to the patient an effective amount of an α4β7 integrin binding protein comprising: a) a heavy chain variable region (VH) comprising (i) a CDR1 having an amino acid sequence according to any one of SEQ ID NOs: 7-26, 32-58, 60-80, and 84-106; (ii) a CDR2 having an amino acid sequence according to any one of SEQ ID NOs: 113-132, 138-164, 166-186, and 190-212; and (iii) a CDR3 having an amino acid sequence according to any one of SEQ ID NOs: 219-238, 244-270, 272-292, and 296-318; and b) a light chain variable region (VL) comprising (i) a CDR1 having an amino acid sequence according to any one of SEQ ID NOs: 325-344, 350-376, 378-398, and 402-424; (ii) a CDR2 having an amino acid sequence according to any one of SEQ ID NOs: 431-450, 456-482, 484-504, and 508-530; and (iii) a CDR3 having an amino acid sequence according to any one of SEQ ID NOs: 537-556, 562-588, 590-610, and 614-636.

Further described herein, in certain embodiments, are methods of treating an inflammatory bowel disease in a patient in need thereof, the method comprising subcutaneously or intravenously administering to the patient an effective amount of an α4β7 integrin binding protein comprising: a) a heavy chain variable region (VH) comprising the amino acid sequence according to any one of SEQ ID NOs: 1909, 1910, 1935-1939, 1967; and b) a light chain variable region (VL) comprising the amino acid sequence according to any one of SEQ ID NOs: 2015, 2016, 2041-2045, 2073.

Further described herein, in certain embodiments, are methods of treating an inflammatory bowel disease in a patient in need thereof, the method comprising subcutaneously or intravenously administering to the patient an effective amount of an α4β7 integrin binding protein as described above. comprising: a) a heavy chain variable region (VH) comprising (i) a CDR1 having an amino acid sequence according to any one of SEQ ID NOs: 1-106, (ii) a CDR2 having an amino acid sequence according to any one of SEQ ID NOs: 107-212, and (iii) a CDR3 having an amino acid sequence according to any one of SEQ ID NOs: 213-318; b) a light chain variable region (VL) comprising (i) a CDR1 having an amino acid sequence according to any one of SEQ ID NOs: 319-424, (ii) a CDR2 having an amino acid sequence according to any one of SEQ ID NOs: 425-530, and (iii) a CDR3 having an amino acid sequence according to any one of SEQ ID NOs: 531-636; and c) a modified Fc that comprises amino acid modifications M252Y, S254T, and T256E (YTE) and/or L234A/G237A (LAGA).

Further described herein, in certain embodiments, are methods of treating an inflammatory bowel disease in a patient in need thereof, the method comprising subcutaneously or intravenously administering to the patient an effective amount of an α4β7 integrin binding protein comprising a modified Fc that extends half-life of the α4β7 binding protein as compared to an α4β7 binding protein that does not comprise the modified Fc.

Further described herein, in certain embodiments, are methods of treating an inflammatory bowel disease in a patient in need thereof, the method comprising subcutaneously or intravenously administering to the patient an effective amount of an α4β7 integrin binding protein, wherein the α4β7 binding protein specifically binds to an epitope of α4β7 and comprises a Fc domain comprising amino acid modifications M252Y, S254T, and T256E (YTE) and/or L234A/G237A (LAGA).

In some embodiments, the inflammatory bowel disease is Crohn's disease or ulcerative colitis. In some embodiments, the inflammatory bowel disease is ulcerative colitis. In some embodiments, the inflammatory bowel disease is Crohn's disease.

In some embodiments, administration of the α4β7 integrin binding protein is intravenous, intratumoral, intramuscular, subcutaneous, intralesional, intraintestinal, intracolonic, intrarectal, intrapouch, or intraperitoneal. In some embodiments, administration of the α4β7 integrin binding protein is through a parenteral route such as intravenous, intramuscular, subcutaneous, intraarterial, or intraperitoneal administration. In some embodiments, administration of the α4β7 integrin binding protein is intravenous or subcutaneous. In some embodiments, administration of the α4β7 integrin binding protein is intravenous. In some embodiments, administration of the α4β7 integrin binding protein is subcutaneous.

Administration of the α4β7 integrin binding protein can occur at various intervals and various doses.

Pharmaceutical Compositions

The present disclosure also features pharmaceutical compositions that contain a therapeutically effective amount of the α4β7 integrin binding proteins described herein. The composition can be formulated for use in a variety of drug delivery systems. One or more physiologically acceptable excipients or carriers can also be included in the composition for proper formulation. Suitable formulations for use in the present disclosure are found in Remington's Pharmaceutical Sciences, Mack Publishing Company, Philadelphia, Pa., 17th ed., 1985. For a brief review of methods for drug delivery, see, e.g., Langer (Science 249:1527-1533, 1990).

In some embodiments, a pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants (see, Remington's Pharmaceutical Sciences, 18th ed. (Mack Publishing Company, 1990)).

In some embodiments, a pharmaceutical composition is citrate-free.

In some embodiments, a pharmaceutical composition may contain nanoparticles, e.g., polymeric nanoparticles, liposomes, or micelles.

In some embodiments, a pharmaceutical composition may contain a sustained- or controlled-delivery formulation. Techniques for formulating sustained- or controlled-delivery means, such as liposome carriers, bio-erodible microparticles or porous beads and depot injections, are also known to those skilled in the art. Sustained-release preparations may include, e.g., porous polymeric microparticles or semipermeable polymer matrices in the form of shaped articles, e.g., films, or microcapsules. Sustained release matrices may include polyesters, hydrogels, polylactides, copolymers of L-glutamic acid and gamma ethyl-L-glutamate, poly (2-hydroxyethyl-inethacrylate), ethylene vinyl acetate, or poly-D (−)-3-hydroxybutyric acid. Sustained release compositions may also include liposomes that can be prepared by any of several methods known in the art.

Pharmaceutical compositions containing an α4β7 integrin binding protein disclosed herein can be presented in a dosage unit form and can be prepared by any suitable method. A pharmaceutical composition should be formulated to be compatible with its intended route of administration. Examples of routes of administration are intravenous (IV), intradermal, inhalation, transdermal, topical, transmucosal, intrathecal and rectal administration. In some embodiments, the α4β7 integrin binding protein disclosed herein is administered intravenously or subcutaneously. In some embodiments, the α4β7 integrin binding protein disclosed herein is administered intravenously. In some embodiments, the α4β7 integrin binding protein disclosed herein is administered subcutaneously.

Useful formulations can be prepared by methods known in the pharmaceutical art. For example, see Remington's Pharmaceutical Sciences, 18th ed. (Mack Publishing Company, 1990). Formulation components suitable for parenteral administration include a sterile diluent such as water for injection, saline solution, fixed oils, polyethylene glycols, glycerin, propylene glycol or other synthetic solvents; antibacterial agents such as benzyl alcohol or methyl parabens; antioxidants such as ascorbic acid or sodium bisulfite; chelating agents such as EDTA; buffers such as acetates, citrates or phosphates; and agents for the adjustment of tonicity such as sodium chloride or dextrose. In some embodiments, the formulation for parenteral administration is citrate-free.

For intravenous or subcutaneous administration, suitable carriers include physiological saline, bacteriostatic water, Cremophor EL™ (BASF, Parsippany, NJ) or phosphate buffered saline (PBS). The carrier should be stable under the conditions of manufacture and storage, and should be preserved against microorganisms. The carrier can be a solvent or dispersion medium containing, for example, water, ethanol, polyol (for example, glycerol, propylene glycol, and liquid polyetheylene glycol), and suitable mixtures thereof.

An intravenous or subcutaneous drug delivery formulation may be contained in a syringe, pen, or bag. In some embodiments, the bag is connected to a channel comprising a tube and/or a needle. In some embodiments, the formulation is a lyophilized formulation or a liquid formulation. In some embodiments, the formulation is an injectable liquid formulation. Various devices can be used to deliver liquid formulations by subcutaneous route of administration, including on-body infusion devices, autoinjector devices, prefilled syringes, and syringes. Generally, administration time depends on volume and device, and can range from seconds to minutes.

These compositions may be sterilized by conventional sterilization techniques, or may be sterile filtered. The resulting aqueous solutions may be packaged for use as-is, or lyophilized, the lyophilized preparation being combined with a sterile aqueous carrier prior to administration.

A polyol, which acts as a tonicifier and may stabilize the α4β7 integrin binding protein, may also be included in the formulation. The polyol is added to the formulation in an amount which may vary with respect to the desired isotonicity of the formulation. In some embodiments, the aqueous formulation is isotonic. The amount of polyol added may also be altered with respect to the molecular weight of the polyol. For example, a lower amount of a monosaccharide (e.g., mannitol) is added, compared to a disaccharide (such as trehalose). In some embodiments, the polyol which is used in the formulation as a tonicity agent is mannitol.

A detergent or surfactant may also be added to the formulation. Exemplary detergents include nonionic detergents such as polysorbates (e.g., polysorbates 20, 80 etc.) or poloxamers (e.g., poloxamer 188). The amount of detergent added is such that it reduces aggregation of the formulated antibody and/or minimizes the formation of particulates in the formulation and/or reduces adsorption. In some embodiments, the formulation may include a surfactant which is a polysorbate. In some embodiments, the formulation may contain the detergent polysorbate 80 or Tween 80. Tween 80 is a term used to describe polyoxyethylene (20) sorbitanmonooleate (see Fiedler, Lexikon der Hifsstoffe, Editio Cantor Verlag Aulendorf, 4th edi., 1996).

In embodiments, the protein product of the present disclosure is formulated as a liquid formulation. In some embodiments, the liquid formulation is prepared in combination with a sugar at stabilizing levels. In some embodiments, the liquid formulation is prepared in an aqueous carrier. In some embodiments, a stabilizer is added in an amount no greater than that which may result in a viscosity undesirable or unsuitable for intravenous administration. In some embodiments, the sugar is disaccharides, e.g., sucrose. In some embodiments, the liquid formulation may also include one or more of a buffering agent, a surfactant, and a preservative.

In some embodiments, the pH of the liquid formulation is set by addition of a pharmaceutically acceptable acid and/or base. In some embodiments, the pharmaceutically acceptable acid is hydrochloric acid. In some embodiments, the base is sodium hydroxide.

The aqueous carrier of interest herein is one which is pharmaceutically acceptable (safe and non-toxic for administration to a human) and is useful for the preparation of a liquid formulation. Illustrative carriers include sterile water for injection (SWFI), bacteriostatic water for injection (BWFI), a pH buffered solution (e.g., phosphate-buffered saline), sterile saline solution, Ringer's solution or dextrose solution.

A preservative may be optionally added to the formulations herein to reduce bacterial action. The addition of a preservative may, for example, facilitate the production of a multi-use (multiple-dose) formulation.

The α4β7 integrin binding protein may be lyophilized to produce a lyophilized formulation including the proteins and a lyoprotectant. The lyoprotectant may be sugar, e.g., disaccharides. In some embodiments, the lyoprotectant is sucrose or maltose. The lyophilized formulation may also include one or more of a buffering agent, a surfactant, a bulking agent, and/or a preservative.

The amount of sucrose or maltose useful for stabilization of the lyophilized drug product may be in a weight ratio of at least 1:2 protein to sucrose or maltose. In some embodiments, the protein to sucrose or maltose weight ratio is of from 1:2 to 1:5. In some embodiments, the pH of the formulation, prior to lyophilization, is set by addition of a pharmaceutically acceptable acid and/or base. In some embodiments, the pharmaceutically acceptable acid is hydrochloric acid. In some embodiments, the pharmaceutically acceptable base is sodium hydroxide.

In some embodiments, the α4β7 integrin binding protein is administered at an uniform dose. Alternatively, a patient's dose can be tailored to the approximate body weight or surface area of the patient. Other factors in determining the appropriate dosage can include the disease or condition to be treated or prevented, the severity of the disease, the route of administration, and the age, sex, and medical condition of the patient. Further refinement of the calculations necessary to determine the appropriate dosage for treatment is routinely made by those skilled in the art, especially in light of the dosage information and assays disclosed herein. The dosage can also be determined through the use of known assays for determining dosages used in conjunction with appropriate dose-response data. An individual patient's dosage can be adjusted as the progress of the disease is monitored. Blood levels of the targetable construct or complex in a patient can be measured to see if the dosage needs to be adjusted to reach or maintain an effective concentration. Pharmacogenomics may be used to determine which targetable constructs and/or complexes, and dosages thereof, are most likely to be effective for a given individual (Schmitz et al., *Clinica Chimica Acta* 308: 43-53, 2001; Steimer et al., *Clinica Chimica Acta* 308: 33-41, 2001).

Methods of Preparation

The α4β7 integrin binding proteins described above can be made using recombinant DNA technology well known to a skilled person in the art. For example, one or more isolated polynucleotides encoding the α4β7 integrin binding protein can be ligated to other appropriate nucleotide sequences, including, for example, constant region coding sequences, and expression control sequences, to produce conventional gene expression constructs (i.e., expression vectors) encoding the desired α4β7 integrin binding proteins. Production of defined gene constructs is within routine skill in the art.

Nucleic acids encoding desired α4β7 integrin binding proteins can be incorporated (ligated) into expression vectors, which can be introduced into host cells through conventional transfection or transformation techniques. Exemplary host cells are *E. coli* cells, Chinese hamster ovary (CHO) cells, human embryonic kidney 293 (HEK 293) cells, HeLa cells, baby hamster kidney (BHK) cells, monkey kidney cells (COS), human hepatocellular carcinoma cells (e.g., Hep G2), and myeloma cells that do not otherwise produce IgG protein. Transformed host cells can be grown under conditions that permit the host cells to express the genes that encode α4β7 integrin binding proteins.

Specific expression and purification conditions will vary depending upon the expression system employed. For example, if a gene is to be expressed in *E. coli*, it is first cloned into an expression vector by positioning the engineered gene downstream from a suitable bacterial promoter, e.g., Trp or Tac, and a prokaryotic signal sequence. The expressed protein may be secreted. The expressed protein may accumulate in refractile or inclusion bodies, which can be harvested after disruption of the cells by French press or sonication. The refractile bodies then are solubilized, and the protein may be refolded and/or cleaved by methods known in the art.

If the engineered gene is to be expressed in eukaryotic host cells, e.g., CHO cells, it is first inserted into an expression vector containing a suitable eukaryotic promoter, a secretion signal, a poly A sequence, and a stop codon. Optionally, the vector or gene construct may contain enhancers and introns. In embodiments involving fusion proteins comprising an α4β7 integrin binding protein or portion thereof, the expression vector optionally contains sequences encoding all or part of a constant region, enabling an entire, or a part of, a heavy or light chain to be expressed. The gene construct can be introduced into eukaryotic host cells using conventional techniques.

In some embodiments, in order to express an α4β7 integrin binding protein, an N-terminal signal sequence is included in the protein construct. Exemplary N-terminal signal sequences include signal sequences from interleukin-2, CD-5, IgG kappa light chain, trypsinogen, serum albumin, and prolactin.

After transfection, single clones can be isolated for cell bank generation using methods known in the art, such as limited dilution, ELISA, FACS, microscopy, or Clonepix. Clones can be cultured under conditions suitable for bioreactor scale-up and maintained expression of the α4β7 integrin binding proteins.

The α4β7 integrin binding proteins can be isolated and purified using methods known in the art including centrifugation, depth filtration, cell lysis, homogenization, freeze-thawing, affinity purification, gel filtration, ion exchange chromatography, hydrophobic interaction exchange chromatography, and mixed-mode chromatography.

Specific Embodiments

Non-limiting specific embodiments are described below, each of which is considered to be within the present disclosure.

Embodiment 1. An α4β7 binding protein comprising:
a) a heavy chain variable region (VH) comprising (i) a CDR1 having an amino acid sequence according to SEQ ID NO: 3, (ii) a CDR2 having an amino acid sequence according to SEQ ID NO: 109, and (iii) a CDR3 having an amino acid sequence according to SEQ ID NO: 215; and a light chain variable region (VL) comprising (i) a CDR1 having an amino acid sequence according to SEQ ID NO: 321, (ii) a CDR2 having an amino acid sequence according to SEQ ID NO: 427, and (iii) a CDR3 having an amino acid sequence according to SEQ ID NO: 533;
b) a heavy chain variable region (VH) comprising (i) a CDR1 having an amino acid sequence according to SEQ ID NO: 4, (ii) a CDR2 having an amino acid sequence according to SEQ ID NO: 110, and (iii) a CDR3 having an amino acid sequence according to SEQ ID NO: 216; and a light chain variable region (VL) comprising (i) a CDR1 having an amino acid sequence according to SEQ ID NO: 322, (ii) a CDR2 having an amino acid sequence according to SEQ ID NO: 428, and (iii) a CDR3 having an amino acid sequence according to SEQ ID NO: 534;
c) a heavy chain variable region (VH) comprising (i) a CDR1 having an amino acid sequence according to SEQ ID NO: 5, (ii) a CDR2 having an amino acid sequence according to SEQ ID NO: 111, and (iii) a CDR3 having an amino acid sequence according to SEQ ID NO: 217; and a light chain variable region (VL) comprising (i) a CDR1 having an amino acid sequence according to SEQ ID NO: 323, (ii) a CDR2 having an amino acid sequence according to SEQ ID NO: 429, and (iii) a CDR3 having an amino acid sequence according to SEQ ID NO: 535;
d) a heavy chain variable region (VH) comprising (i) a CDR1 having an amino acid sequence according to SEQ ID NO: 6, (ii) a CDR2 having an amino acid sequence according to SEQ ID NO: 112, and (iii) a CDR3 having an amino acid sequence according to SEQ ID NO: 218; and a light chain variable region (VL) comprising (i) a CDR1 having an amino acid sequence according to SEQ ID NO: 324, (ii) a CDR2 having an amino acid sequence according to SEQ ID NO: 430, and (iii) a CDR3 having an amino acid sequence according to SEQ ID NO: 536;

e) a heavy chain variable region (VH) comprising (i) a CDR1 having an amino acid sequence according to SEQ ID NO: 81, (ii) a CDR2 having an amino acid sequence according to SEQ ID NO: 187, and (iii) a CDR3 having an amino acid sequence according to SEQ ID NO: 293; and a light chain variable region (VL) comprising (i) a CDR1 having an amino acid sequence according to SEQ ID NO: 399, (ii) a CDR2 having an amino acid sequence according to SEQ ID NO: 505, and (iii) a CDR3 having an amino acid sequence according to SEQ ID NO: 611;

f) a heavy chain variable region (VH) comprising (i) a CDR1 having an amino acid sequence according to SEQ ID NO: 82, (ii) a CDR2 having an amino acid sequence according to SEQ ID NO: 188, and (iii) a CDR3 having an amino acid sequence according to SEQ ID NO: 294; and a light chain variable region (VL) comprising (i) a CDR1 having an amino acid sequence according to SEQ ID NO: 400, (ii) a CDR2 having an amino acid sequence according to SEQ ID NO: 506, and (iii) a CDR3 having an amino acid sequence according to SEQ ID NO: 612; or g) a heavy chain variable region (VH) comprising (i) a CDR1 having an amino acid sequence according to SEQ ID NO: 83, (ii) a CDR2 having an amino acid sequence according to SEQ ID NO: 189, and (iii) a CDR3 having an amino acid sequence according to SEQ ID NO: 295; and a light chain variable region (VL) comprising (i) a CDR1 having an amino acid sequence according to SEQ ID NO: 401, (ii) a CDR2 having an amino acid sequence according to SEQ ID NO: 507, and (iii) a CDR3 having an amino acid sequence according to SEQ ID NO: 613.

Embodiment 2. The α4β7 binding protein of embodiment 1, wherein the VH comprises a sequence having at least 80% sequence identity to the amino acid sequence of any one of SEQ ID NOs: 1911-1914 and 1925-1927; and the VL comprises a sequence having at least 80% sequence identity to the amino acid sequence of any one of SEQ ID NOs: 2017-2020 and 2031-2033.

Embodiment 3. The α4β7 binding protein of embodiment 2, wherein the VH comprises a sequence having at least 80% sequence identity to the amino acid sequence of SEQ ID NO: 1911 and the VL comprises a sequence having at least 80% sequence identity to the amino acid sequence of SEQ ID NO: 2017.

Embodiment 4. The α4β7 binding protein of embodiment 2, wherein the VH comprises a sequence having at least 80% sequence identity to the amino acid sequence of SEQ ID NO: 1912 and the VL comprises a sequence having at least 80% sequence identity to the amino acid sequence of SEQ ID NO: 2018.

Embodiment 5. The α4β7 binding protein of embodiment 2, wherein the VH comprises a sequence having at least 80% sequence identity to the amino acid sequence of SEQ ID NO: 1913 and the VL comprises a sequence having at least 80% sequence identity to the amino acid sequence of SEQ ID NO: 2019.

Embodiment 6. The α4β7 binding protein of embodiment 2, wherein the VH comprises a sequence having at least 80% sequence identity to the amino acid sequence of SEQ ID NO: 1914 and the VL comprises a sequence having at least 80% sequence identity to the amino acid sequence of SEQ ID NO: 2020.

Embodiment 7. The α4β7 binding protein of embodiment 2, wherein the VH comprises a sequence having at least 80% sequence identity to the amino acid sequence of SEQ ID NO: 1925 and the VL comprises a sequence having at least 80% sequence identity to the amino acid sequence of SEQ ID NO: 2031.

Embodiment 8. The α4β7 binding protein of embodiment 2, wherein the VH comprises a sequence having at least 80% sequence identity to the amino acid sequence of SEQ ID NO: 1926 and the VL comprises a sequence having at least 80% sequence identity to the amino acid sequence of SEQ ID NO: 2032.

Embodiment 9. The α4β7 binding protein of embodiment 2, wherein the VH comprises a sequence having at least 80% sequence identity to the amino acid sequence of SEQ ID NO: 1927 and the VL comprises a sequence having at least 80% sequence identity to the amino acid sequence of SEQ ID NO: 2033.

Embodiment 10. An α4β7 binding protein comprising:

a) a heavy chain variable region (VH) comprising (i) a CDR1 having an amino acid sequence according to any one of SEQ ID NOs: 7-26, 32-58, 60-80, and 84-106; (ii) a CDR2 having an amino acid sequence according to any one of SEQ ID NOs: 113-132, 138-164, 166-186, and 190-212; and (iii) a CDR3 having an amino acid sequence according to any one of SEQ ID NOs: 219-238, 244-270, 272-292, and 296-318; and b) a light chain variable region (VL) comprising (i) a CDR1 having an amino acid sequence according to any one of SEQ ID NOs: 325-344, 350-376, 378-398, and 402-424; (ii) a CDR2 having an amino acid sequence according to any one of SEQ ID NOs: 431-450, 456-482, 484-504, and 508-530; and (iii) a CDR3 having an amino acid sequence according to any one of SEQ ID NOs: 537-556, 562-588, 590-610, and 614-636.

Embodiment 11. The α4β7 binding protein of embodiment 10, wherein the VH comprises (i) a CDR1 having an amino acid sequence according to SEQ ID NO: 7; (ii) a CDR2 having an amino acid sequence according to SEQ ID NO: 113; and (iii) a CDR3 having an amino acid sequence according to SEQ ID NO: 219; and the VL comprises (i) a CDR1 having an amino acid sequence according to SEQ ID NO: 325; (ii) a CDR2 having an amino acid sequence according to SEQ ID NO: 431; and (iii) a CDR3 having an amino acid sequence according to SEQ ID NO: 537.

Embodiment 12. The α4β7 binding protein of embodiment 10, wherein the VH comprises (i) a CDR1 having an amino acid sequence according to SEQ ID NO: 8; (ii) a CDR2 having an amino acid sequence according to SEQ ID NO: 114; and (iii) a CDR3 having an amino acid sequence according to SEQ ID NO: 220; and the VL comprises (i) a CDR1 having an amino acid sequence according to SEQ ID NO: 326; (ii) a CDR2 having an amino acid sequence according to SEQ ID NO: 432; and (iii) a CDR3 having an amino acid sequence according to SEQ ID NO: 538.

Embodiment 13. The α4β7 binding protein of embodiment 10, wherein the VH comprises (i) a CDR1 having an amino acid sequence according to SEQ ID NO: 9; (ii) a CDR2 having an amino acid sequence according to SEQ ID NO: 115; and (iii) a CDR3 having an amino acid sequence according to SEQ ID NO: 221; and the VL comprises (i) a CDR1 having an amino acid sequence according to SEQ ID NO: 327; (ii) a CDR2 having an amino acid sequence according to SEQ ID NO: 433; and (iii) a CDR3 having an amino acid sequence according to SEQ ID NO: 539.

Embodiment 14. The α4β7 binding protein of embodiment 10, wherein the VH comprises (i) a CDR1 having an amino acid sequence according to SEQ ID NO: 10; (ii) a CDR2 having an amino acid sequence according to SEQ ID NO: 116; and (iii) a CDR3 having an amino acid sequence according to SEQ ID NO: 222; and the VL comprises (i) a CDR1 having an amino acid sequence according to SEQ ID NO: 328; (ii) a CDR2 having an amino acid sequence according to SEQ ID NO: 434; and (iii) a CDR3 having an amino acid sequence according to SEQ ID NO: 540.

Embodiment 15. The α4β7 binding protein of embodiment 10, wherein the VH comprises (i) a CDR1 having an amino acid sequence according to SEQ ID NO: 11; (ii) a CDR2 having an amino acid sequence according to SEQ ID NO: 117; and (iii) a CDR3 having an amino acid sequence according to SEQ ID NO: 223; and the VL comprises (i) a CDR1 having an amino acid sequence according to SEQ ID NO: 329; (ii) a CDR2 having an amino acid sequence according to SEQ ID NO: 435; and (iii) a CDR3 having an amino acid sequence according to SEQ ID NO: 541.

Embodiment 16. The α4β7 binding protein of embodiment 10, wherein the VH comprises (i) a CDR1 having an amino acid sequence according to SEQ ID NO: 12; (ii) a CDR2 having an amino acid sequence according to SEQ ID NO: 118; and (iii) a CDR3 having an amino acid sequence according to SEQ ID NO: 224; and the VL comprises (i) a CDR1 having an amino acid sequence according to SEQ ID NO: 330; (ii) a CDR2 having an amino acid sequence according to SEQ ID NO: 436; and (iii) a CDR3 having an amino acid sequence according to SEQ ID NO: 542.

Embodiment 17. The α4β7 binding protein of embodiment 10, wherein the VH comprises (i) a CDR1 having an amino acid sequence according to SEQ ID NO: 13; (ii) a CDR2 having an amino acid sequence according to SEQ ID NO: 119; and (iii) a CDR3 having an amino acid sequence according to SEQ ID NO: 225; and the VL comprises (i) a CDR1 having an amino acid sequence according to SEQ ID NO: 331; (ii) a CDR2 having an amino acid sequence according to SEQ ID NO: 437; and (iii) a CDR3 having an amino acid sequence according to SEQ ID NO: 543.

Embodiment 18. The α4β7 binding protein of embodiment 10, wherein the VH comprises (i) a CDR1 having an amino acid sequence according to SEQ ID NO: 14; (ii) a CDR2 having an amino acid sequence according to SEQ ID NO: 120; and (iii) a CDR3 having an amino acid sequence according to SEQ ID NO: 226; and the VL comprises (i) a CDR1 having an amino acid sequence according to SEQ ID NO: 332; (ii) a CDR2 having an amino acid sequence according to SEQ ID NO: 438; and (iii) a CDR3 having an amino acid sequence according to SEQ ID NO: 544.

Embodiment 19. The α4β7 binding protein of embodiment 10, wherein the VH comprises (i) a CDR1 having an amino acid sequence according to SEQ ID NO: 15; (ii) a CDR2 having an amino acid sequence according to SEQ ID NO: 121; and (iii) a CDR3 having an amino acid sequence according to SEQ ID NO: 227; and the VL comprises (i) a CDR1 having an amino acid sequence according to SEQ ID NO: 333; (ii) a CDR2 having an amino acid sequence according to SEQ ID NO: 439; and (iii) a CDR3 having an amino acid sequence according to SEQ ID NO: 545.

Embodiment 20. The α4β7 binding protein of embodiment 10, wherein the VH comprises (i) a CDR1 having an amino acid sequence according to SEQ ID NO: 16; (ii) a CDR2 having an amino acid sequence according to SEQ ID NO: 122; and (iii) a CDR3 having an amino acid sequence according to SEQ ID NO: 228; and the VL comprises (i) a CDR1 having an amino acid sequence according to SEQ ID NO: 334; (ii) a CDR2 having an amino acid sequence according to SEQ ID NO: 440; and (iii) a CDR3 having an amino acid sequence according to SEQ ID NO: 546.

Embodiment 21. The α4β7 binding protein of embodiment 10, wherein the VH comprises (i) a CDR1 having an amino acid sequence according to SEQ ID NO: 17; (ii) a CDR2 having an amino acid sequence according to SEQ ID NO: 123; and (iii) a CDR3 having an amino acid sequence according to SEQ ID NO: 229; and the VL comprises (i) a CDR1 having an amino acid sequence according to SEQ ID NO: 335; (ii) a CDR2 having an amino acid sequence according to SEQ ID NO: 441; and (iii) a CDR3 having an amino acid sequence according to SEQ ID NO: 547.

Embodiment 22. The α4β7 binding protein of embodiment 10, wherein the VH comprises (i) a CDR1 having an amino acid sequence according to SEQ ID NO: 18; (ii) a CDR2 having an amino acid sequence according to SEQ ID NO: 124; and (iii) a CDR3 having an amino acid sequence according to SEQ ID NO: 230; and the VL comprises (i) a CDR1 having an amino acid sequence according to SEQ ID NO: 336; (ii) a CDR2 having an amino acid sequence according to SEQ ID NO: 442; and (iii) a CDR3 having an amino acid sequence according to SEQ ID NO: 548.

Embodiment 23. The α4β7 binding protein of embodiment 10, wherein the VH comprises (i) a CDR1 having an amino acid sequence according to SEQ ID NO: 19; (ii) a CDR2 having an amino acid sequence according to SEQ ID NO: 125; and (iii) a CDR3 having an amino acid sequence according to SEQ ID NO: 231; and the VL comprises (i) a CDR1 having an amino acid sequence according to SEQ ID NO: 337; (ii) a CDR2 having an amino acid sequence according to SEQ ID NO: 443; and (iii) a CDR3 having an amino acid sequence according to SEQ ID NO: 549.

Embodiment 24. The α4β7 binding protein of embodiment 10, wherein the VH comprises (i) a CDR1 having an amino acid sequence according to SEQ ID NO: 20; (ii) a CDR2 having an amino acid sequence according to SEQ ID NO: 126; and (iii) a CDR3 having an amino acid sequence according to SEQ ID NO: 232; and the VL comprises (i) a CDR1 having an amino acid sequence according to SEQ ID NO: 338; (ii) a CDR2 having an amino acid sequence according to SEQ ID NO: 444; and (iii) a CDR3 having an amino acid sequence according to SEQ ID NO: 550.

Embodiment 25. The α4β7 binding protein of embodiment 10, wherein the VH comprises (i) a CDR1 having an amino acid sequence according to SEQ ID NO: 21; (ii) a CDR2 having an amino acid sequence according to SEQ ID NO: 127; and (iii) a CDR3 having an amino acid sequence according to SEQ ID NO: 233; and the VL comprises (i) a CDR1 having an amino acid sequence according to SEQ ID NO: 339; (ii) a CDR2 having an amino acid sequence according to SEQ ID NO: 445; and (iii) a CDR3 having an amino acid sequence according to SEQ ID NO: 551.

Embodiment 26. The α4β7 binding protein of embodiment 10, wherein the VH comprises (i) a CDR1 having an amino acid sequence according to SEQ ID NO: 22; (ii) a CDR2 having an amino acid sequence according to SEQ ID NO: 128; and (iii) a CDR3 having an amino acid sequence according to SEQ ID NO: 234; and the VL comprises (i) a CDR1 having an amino acid sequence according to SEQ ID NO: 340; (ii) a CDR2 having an amino acid sequence according to SEQ ID NO: 446; and (iii) a CDR3 having an amino acid sequence according to SEQ ID NO: 552.

Embodiment 27. The α4β7 binding protein of embodiment 10, wherein the VH comprises (i) a CDR1 having an amino acid sequence according to SEQ ID NO: 23; (ii) a CDR2 having an amino acid sequence according to SEQ ID NO: 129; and (iii) a CDR3 having an amino acid sequence according to SEQ ID NO: 235; and the VL comprises (i) a CDR1 having an amino acid sequence according to SEQ ID NO: 341; (ii) a CDR2 having an amino acid sequence according to SEQ ID NO: 447; and (iii) a CDR3 having an amino acid sequence according to SEQ ID NO: 553.

Embodiment 28. The α4β7 binding protein of embodiment 10, wherein the VH comprises (i) a CDR1 having an amino acid sequence according to SEQ ID NO: 24; (ii) a CDR2 having an amino acid sequence according to SEQ ID NO: 130; and (iii) a CDR3 having an amino acid sequence according to SEQ ID NO: 236; and the VL comprises (i) a CDR1 having an amino acid sequence according to SEQ ID NO: 342; (ii) a CDR2 having an amino acid sequence according to SEQ ID NO: 448; and (iii) a CDR3 having an amino acid sequence according to SEQ ID NO: 554.

Embodiment 29. The α4β7 binding protein of embodiment 10, wherein the VH comprises (i) a CDR1 having an amino acid sequence according to SEQ ID NO: 25; (ii) a CDR2 having an amino acid sequence according to SEQ ID NO: 131; and (iii) a CDR3 having an amino acid sequence according to SEQ ID NO: 237; and the VL comprises (i) a CDR1 having an amino acid sequence according to SEQ ID NO: 343; (ii) a CDR2 having an amino acid sequence according to SEQ ID NO: 449; and (iii) a CDR3 having an amino acid sequence according to SEQ ID NO: 555.

Embodiment 30. The α4β7 binding protein of embodiment 10, wherein the VH comprises (i) a CDR1 having an amino acid sequence according to SEQ ID NO: 26; (ii) a CDR2 having an amino acid sequence according to SEQ ID NO: 132; and (iii) a CDR3 having an amino acid sequence according to SEQ ID NO: 238; and the VL comprises (i) a CDR1 having an amino acid sequence according to SEQ ID NO: 344; (ii) a CDR2 having an amino acid sequence according to SEQ ID NO: 450; and (iii) a CDR3 having an amino acid sequence according to SEQ ID NO: 556.

Embodiment 31. The α4β7 binding protein of embodiment 10, wherein the VH comprises (i) a CDR1 having an amino acid sequence according to SEQ ID NO: 32; (ii) a CDR2 having an amino acid sequence according to SEQ ID NO: 138; and (iii) a CDR3 having an amino acid sequence according to SEQ ID NO: 244; and the VL comprises (i) a CDR1 having an amino acid sequence according to SEQ ID NO: 350; (ii) a CDR2 having an amino acid sequence according to SEQ ID NO: 456; and (iii) a CDR3 having an amino acid sequence according to SEQ ID NO: 562.

Embodiment 32. The α4β7 binding protein of embodiment 10, wherein the VH comprises (i) a CDR1 having an amino acid sequence according to SEQ ID NO: 33; (ii) a CDR2 having an amino acid sequence according to SEQ ID NO: 139; and (iii) a CDR3 having an amino acid sequence according to SEQ ID NO: 245; and the VL comprises (i) a CDR1 having an amino acid sequence according to SEQ ID NO: 351; (ii) a CDR2 having an amino acid sequence according to SEQ ID NO: 457; and (iii) a CDR3 having an amino acid sequence according to SEQ ID NO: 563.

Embodiment 33. The α4β7 binding protein of embodiment 10, wherein the VH comprises (i) a CDR1 having an amino acid sequence according to SEQ ID NO: 34; (ii) a CDR2 having an amino acid sequence according to SEQ ID NO: 140; and (iii) a CDR3 having an amino acid sequence according to SEQ ID NO: 246; and the VL comprises (i) a CDR1 having an amino acid sequence according to SEQ ID NO: 352; (ii) a CDR2 having an amino acid sequence according to SEQ ID NO: 458; and (iii) a CDR3 having an amino acid sequence according to SEQ ID NO: 564.

Embodiment 34. The α4β7 binding protein of embodiment 10, wherein the VH comprises (i) a CDR1 having an amino acid sequence according to SEQ ID NO: 35; (ii) a CDR2 having an amino acid sequence according to SEQ ID NO: 141; and (iii) a CDR3 having an amino acid sequence according to SEQ ID NO: 247; and the VL comprises (i) a CDR1 having an amino acid sequence according to SEQ ID NO: 353; (ii) a CDR2 having an amino acid sequence according to SEQ ID NO: 459; and (iii) a CDR3 having an amino acid sequence according to SEQ ID NO: 565.

Embodiment 35. The α4β7 binding protein of embodiment 10, wherein the VH comprises (i) a CDR1 having an amino acid sequence according to SEQ ID NO: 36; (ii) a CDR2 having an amino acid sequence according to SEQ ID NO: 142; and (iii) a CDR3 having an amino acid sequence according to SEQ ID NO: 248; and the VL comprises (i) a CDR1 having an amino acid sequence according to SEQ ID NO: 354; (ii) a CDR2 having an amino acid sequence according to SEQ ID NO: 460; and (iii) a CDR3 having an amino acid sequence according to SEQ ID NO: 566.

Embodiment 36. The α4β7 binding protein of embodiment 10, wherein the VH comprises (i) a CDR1 having an amino acid sequence according to SEQ ID NO: 37; (ii) a CDR2 having an amino acid sequence according to SEQ ID NO: 143; and (iii) a CDR3 having an amino acid sequence according to SEQ ID NO: 249; and the VL comprises (i) a CDR1 having an amino acid sequence according to SEQ ID NO: 355; (ii) a CDR2 having an amino acid sequence according to SEQ ID NO: 461; and (iii) a CDR3 having an amino acid sequence according to SEQ ID NO: 567.

Embodiment 37. The α4β7 binding protein of embodiment 10, wherein the VH comprises (i) a CDR1 having an amino acid sequence according to SEQ ID NO: 38; (ii) a CDR2 having an amino acid sequence according to SEQ ID NO: 144; and (iii) a CDR3 having an amino acid sequence according to SEQ ID NO: 250; and the VL comprises (i) a CDR1 having an amino acid sequence according to SEQ ID NO: 356; (ii) a CDR2 having an amino acid sequence according to SEQ ID NO: 462; and (iii) a CDR3 having an amino acid sequence according to SEQ ID NO: 568.

Embodiment 38. The α4β7 binding protein of embodiment 10, wherein the VH comprises (i) a CDR1 having an amino acid sequence according to SEQ ID NO: 39; (ii) a CDR2 having an amino acid sequence according to SEQ ID NO: 145; and (iii) a CDR3 having an amino acid sequence according to SEQ ID NO: 251; and the VL comprises (i) a CDR1 having an amino acid sequence according to SEQ ID NO: 357; (ii) a CDR2 having an amino acid sequence according to SEQ ID NO: 463; and (iii) a CDR3 having an amino acid sequence according to SEQ ID NO: 569.

Embodiment 39. The α4β7 binding protein of embodiment 10, wherein the VH comprises (i) a CDR1 having an amino acid sequence according to SEQ ID NO: 40; (ii) a CDR2 having an amino acid sequence according to SEQ ID NO: 146; and (iii) a CDR3 having an amino acid sequence according to SEQ ID NO: 252; and the VL comprises (i) a CDR1 having an amino acid sequence according to SEQ ID NO: 358; (ii) a CDR2 having an amino acid sequence according to SEQ ID NO: 464; and (iii) a CDR3 having an amino acid sequence according to SEQ ID NO: 570.

Embodiment 40. The α4β7 binding protein of embodiment 10, wherein the VH comprises (i) a CDR1 having an amino acid sequence according to SEQ ID NO: 41; (ii) a CDR2 having an amino acid sequence according to SEQ ID NO: 147; and (iii) a CDR3 having an amino acid sequence according to SEQ ID NO: 253; and the VL comprises (i) a CDR1 having an amino acid sequence according to SEQ ID NO: 359; (ii) a CDR2 having an amino acid sequence according to SEQ ID NO: 465; and (iii) a CDR3 having an amino acid sequence according to SEQ ID NO: 571.

Embodiment 41. The α4β7 binding protein of embodiment 10, wherein the VH comprises (i) a CDR1 having an amino acid sequence according to SEQ ID NO: 42; (ii) a CDR2 having an amino acid sequence according to SEQ ID NO: 148; and (iii) a CDR3 having an amino acid sequence according to SEQ ID NO: 254; and the VL comprises (i) a CDR1 having an amino acid sequence according to SEQ ID NO: 360; (ii) a CDR2 having an amino acid sequence according to SEQ ID NO: 466; and (iii) a CDR3 having an amino acid sequence according to SEQ ID NO: 572.

Embodiment 42. The α4β7 binding protein of embodiment 10, wherein the VH comprises (i) a CDR1 having an amino acid sequence according to SEQ ID NO: 43; (ii) a CDR2 having an amino acid sequence according to SEQ ID NO: 149; and (iii) a CDR3 having an amino acid sequence according to SEQ ID NO: 255; and the VL comprises (i) a CDR1 having an amino acid sequence according to SEQ ID NO: 361; (ii) a CDR2 having an amino acid sequence according to SEQ ID NO: 467; and (iii) a CDR3 having an amino acid sequence according to SEQ ID NO: 573.

Embodiment 43. The α4β7 binding protein of embodiment 10, wherein the VH comprises (i) a CDR1 having an amino acid sequence according to SEQ ID NO: 44; (ii) a CDR2 having an amino acid sequence according to SEQ ID NO: 150; and (iii) a CDR3 having an amino acid sequence according to SEQ ID NO: 256; and the VL comprises (i) a CDR1 having an amino acid sequence according to SEQ ID NO: 362; (ii) a CDR2 having an amino acid sequence according to SEQ ID NO: 468; and (iii) a CDR3 having an amino acid sequence according to SEQ ID NO: 574.

Embodiment 44. The α4β7 binding protein of embodiment 10, wherein the VH comprises (i) a CDR1 having an amino acid sequence according to SEQ ID NO: 45; (ii) a CDR2 having an amino acid sequence according to SEQ ID NO: 151; and (iii) a CDR3 having an amino acid sequence according to SEQ ID NO: 257; and the VL comprises (i) a CDR1 having an amino acid sequence according to SEQ ID NO: 363; (ii) a CDR2 having an amino acid sequence according to SEQ ID NO: 469; and (iii) a CDR3 having an amino acid sequence according to SEQ ID NO: 575.

Embodiment 45. The α4β7 binding protein of embodiment 10, wherein the VH comprises (i) a CDR1 having an amino acid sequence according to SEQ ID NO: 46; (ii) a CDR2 having an amino acid sequence according to SEQ ID NO: 152; and (iii) a CDR3 having an amino acid sequence according to SEQ ID NO: 258; and the VL comprises (i) a CDR1 having an amino acid sequence according to SEQ ID NO: 364; (ii) a CDR2 having an amino acid sequence according to SEQ ID NO: 470; and (iii) a CDR3 having an amino acid sequence according to SEQ ID NO: 576.

Embodiment 46. The α4β7 binding protein of embodiment 10, wherein the VH comprises (i) a CDR1 having an amino acid sequence according to SEQ ID NO: 47; (ii) a CDR2 having an amino acid sequence according to SEQ ID NO: 153; and (iii) a CDR3 having an amino acid sequence according to SEQ ID NO: 259; and the VL comprises (i) a CDR1 having an amino acid sequence according to SEQ ID NO: 365; (ii) a CDR2 having an amino acid sequence according to SEQ ID NO: 471; and (iii) a CDR3 having an amino acid sequence according to SEQ ID NO: 577.

Embodiment 47. The α4β7 binding protein of embodiment 10, wherein the VH comprises (i) a CDR1 having an amino acid sequence according to SEQ ID NO: 48; (ii) a CDR2 having an amino acid sequence according to SEQ ID NO: 154; and (iii) a CDR3 having an amino acid sequence according to SEQ ID NO: 260; and the VL comprises (i) a CDR1 having an amino acid sequence according to SEQ ID NO: 366; (ii) a CDR2 having an amino acid sequence according to SEQ ID NO: 472; and (iii) a CDR3 having an amino acid sequence according to SEQ ID NO: 578.

Embodiment 48. The α4β7 binding protein of embodiment 10, wherein the VH comprises (i) a CDR1 having an amino acid sequence according to SEQ ID NO: 49; (ii) a CDR2 having an amino acid sequence according to SEQ ID NO: 155; and (iii) a CDR3 having an amino acid sequence according to SEQ ID NO: 261; and the VL comprises (i) a CDR1 having an amino acid sequence according to SEQ ID NO: 367; (ii) a CDR2 having an amino acid sequence according to SEQ ID NO: 473; and (iii) a CDR3 having an amino acid sequence according to SEQ ID NO: 579.

Embodiment 49. The α4β7 binding protein of embodiment 10, wherein the VH comprises (i) a CDR1 having an amino acid sequence according to SEQ ID NO: 50; (ii) a CDR2 having an amino acid sequence according to SEQ ID NO: 156; and (iii) a CDR3 having an amino acid sequence according to SEQ ID NO: 262; and the VL comprises (i) a CDR1 having an amino acid sequence according to SEQ ID NO: 368; (ii) a CDR2 having an amino acid sequence according to SEQ ID NO: 474; and (iii) a CDR3 having an amino acid sequence according to SEQ ID NO: 580.

Embodiment 50. The α4β7 binding protein of embodiment 10, wherein the VH comprises (i) a CDR1 having an amino acid sequence according to SEQ ID NO: 51; (ii) a CDR2 having an amino acid sequence according to SEQ ID NO: 157; and (iii) a CDR3 having an amino acid sequence according to SEQ ID NO: 263; and the VL comprises (i) a CDR1 having an amino acid sequence according to SEQ ID NO: 369; (ii) a CDR2 having an amino acid sequence according to SEQ ID NO: 475; and (iii) a CDR3 having an amino acid sequence according to SEQ ID NO: 581.

Embodiment 51. The α4β7 binding protein of embodiment 10, wherein the VH comprises (i) a CDR1 having an amino acid sequence according to SEQ ID NO: 52; (ii) a CDR2 having an amino acid sequence according to SEQ ID NO: 158; and (iii) a CDR3 having an amino acid sequence according to SEQ ID NO: 264; and the VL comprises (i) a CDR1 having an amino acid sequence according to SEQ ID NO: 370; (ii) a CDR2 having an amino acid sequence according to SEQ ID NO: 476; and (iii) a CDR3 having an amino acid sequence according to SEQ ID NO: 582.

Embodiment 52. The α4β7 binding protein of embodiment 10, wherein the VH comprises (i) a CDR1 having an amino acid sequence according to SEQ ID NO: 53; (ii) a CDR2 having an amino acid sequence according to SEQ ID NO: 159; and (iii) a CDR3 having an amino acid sequence according to SEQ ID NO: 265; and the VL comprises (i) a CDR1 having an amino acid sequence according to SEQ ID NO: 371; (ii) a CDR2 having an amino acid sequence according to SEQ ID NO: 477; and (iii) a CDR3 having an amino acid sequence according to SEQ ID NO: 583.

Embodiment 53. The α4β7 binding protein of embodiment 10, wherein the VH comprises (i) a CDR1 having an amino acid sequence according to SEQ ID NO: 54; (ii) a CDR2 having an amino acid sequence according to SEQ ID NO: 160; and (iii) a CDR3 having an amino acid sequence according to SEQ ID NO: 266; and the VL comprises (i) a CDR1 having an amino acid sequence according to SEQ ID NO: 372; (ii) a CDR2 having an amino acid sequence according to SEQ ID NO: 478; and (iii) a CDR3 having an amino acid sequence according to SEQ ID NO: 584.

Embodiment 54. The α4β7 binding protein of embodiment 10, wherein the VH comprises (i) a CDR1 having an amino acid sequence according to SEQ ID NO: 55; (ii) a CDR2 having an amino acid sequence according to SEQ ID NO: 161; and (iii) a CDR3 having an amino acid sequence according to SEQ ID NO: 267; and the VL comprises (i) a CDR1 having an amino acid sequence according to SEQ ID NO: 373; (ii) a CDR2 having an amino acid sequence according to SEQ ID NO: 479; and (iii) a CDR3 having an amino acid sequence according to SEQ ID NO: 585.

Embodiment 55. The α4β7 binding protein of embodiment 10, wherein the VH comprises (i) a CDR1 having an amino acid sequence according to SEQ ID NO: 56; (ii) a CDR2 having an amino acid sequence according to SEQ ID NO: 162; and (iii) a CDR3 having an amino acid sequence according to SEQ ID NO: 268; and the VL comprises (i) a CDR1 having an amino acid sequence according to SEQ ID NO: 374; (ii) a CDR2 having an amino acid sequence according to SEQ ID NO: 480; and (iii) a CDR3 having an amino acid sequence according to SEQ ID NO: 586.

Embodiment 56. The α4β7 binding protein of embodiment 10, wherein the VH comprises (i) a CDR1 having an amino acid sequence according to SEQ ID NO: 57; (ii) a CDR2 having an amino acid sequence according to SEQ ID NO: 163; and (iii) a CDR3 having an amino acid sequence according to SEQ ID NO: 269; and the VL comprises (i) a CDR1 having an amino acid sequence according to SEQ ID NO: 375; (ii) a CDR2 having an amino acid sequence according to SEQ ID NO: 481; and (iii) a CDR3 having an amino acid sequence according to SEQ ID NO: 587.

Embodiment 57. The α4β7 binding protein of embodiment 10, wherein the VH comprises (i) a CDR1 having an amino acid sequence according to SEQ ID NO: 58; (ii) a CDR2 having an amino acid sequence according to SEQ ID NO: 164; and (iii) a CDR3 having an amino acid sequence according to SEQ ID NO: 270; and the VL comprises (i) a CDR1 having an amino acid sequence according to SEQ ID NO: 376; (ii) a CDR2 having an amino acid sequence according to SEQ ID NO: 482; and (iii) a CDR3 having an amino acid sequence according to SEQ ID NO: 588.

Embodiment 58. The α4β7 binding protein of embodiment 10, wherein the VH comprises (i) a CDR1 having an amino acid sequence according to SEQ ID NO: 60; (ii) a CDR2 having an amino acid sequence according to SEQ ID NO: 166; and (iii) a CDR3 having an amino acid sequence according to SEQ ID NO: 272; and the VL comprises (i) a CDR1 having an amino acid sequence according to SEQ ID NO: 378; (ii) a CDR2 having an amino acid sequence according to SEQ ID NO: 484; and (iii) a CDR3 having an amino acid sequence according to SEQ ID NO: 590.

Embodiment 59. The α4β7 binding protein of embodiment 10, wherein the VH comprises (i) a CDR1 having an amino acid sequence according to SEQ ID NO: 61; (ii) a CDR2 having an amino acid sequence according to SEQ ID NO: 167; and (iii) a CDR3 having an amino acid sequence according to SEQ ID NO: 273; and the VL comprises (i) a CDR1 having an amino acid sequence according to SEQ ID NO: 379; (ii) a CDR2 having an amino acid sequence according to SEQ ID NO: 485; and (iii) a CDR3 having an amino acid sequence according to SEQ ID NO: 591.

Embodiment 60. The α4β7 binding protein of embodiment 10, wherein the VH comprises (i) a CDR1 having an amino acid sequence according to SEQ ID NO: 62; (ii) a CDR2 having an amino acid sequence according to SEQ ID NO: 168; and (iii) a CDR3 having an amino acid sequence according to SEQ ID NO: 274; and the VL comprises (i) a CDR1 having an amino acid sequence according to SEQ ID NO: 380; (ii) a CDR2 having an amino acid sequence according to SEQ ID NO: 486; and (iii) a CDR3 having an amino acid sequence according to SEQ ID NO: 592.

Embodiment 61. The α4β7 binding protein of embodiment 10, wherein the VH comprises (i) a CDR1 having an amino acid sequence according to SEQ ID NO: 63; (ii) a CDR2 having an amino acid sequence according to SEQ ID NO: 169; and (iii) a CDR3 having an amino acid sequence according to SEQ ID NO: 275; and the VL comprises (i) a CDR1 having an amino acid sequence according to SEQ ID NO: 381; (ii) a CDR2 having an amino acid sequence according to SEQ ID NO: 487; and (iii) a CDR3 having an amino acid sequence according to SEQ ID NO: 593.

Embodiment 62. The α4β7 binding protein of embodiment 10, wherein the VH comprises (i) a CDR1 having an amino acid sequence according to SEQ ID NO: 64; (ii) a CDR2 having an amino acid sequence according to SEQ ID NO: 170; and (iii) a CDR3 having an amino acid sequence according to SEQ ID NO: 276; and the VL comprises (i) a CDR1 having an amino acid sequence according to SEQ ID NO: 382; (ii) a CDR2 having an amino acid sequence according to SEQ ID NO: 488; and (iii) a CDR3 having an amino acid sequence according to SEQ ID NO: 594.

Embodiment 63. The α4β7 binding protein of embodiment 10, wherein the VH comprises (i) a CDR1 having an amino acid sequence according to SEQ ID NO: 65; (ii) a CDR2 having an amino acid sequence according to SEQ ID NO: 171; and (iii) a CDR3 having an amino acid sequence according to SEQ ID NO: 277; and the VL comprises (i) a CDR1 having an amino acid sequence according to SEQ ID NO: 383; (ii) a CDR2 having an amino acid sequence according to SEQ ID NO: 489; and (iii) a CDR3 having an amino acid sequence according to SEQ ID NO: 595.

Embodiment 64. The α4β7 binding protein of embodiment 10, wherein the VH comprises (i) a CDR1 having an amino acid sequence according to SEQ ID NO: 66; (ii) a CDR2 having an amino acid sequence according to SEQ ID NO: 172; and (iii) a CDR3 having an amino acid sequence according to SEQ ID NO: 278; and the VL comprises (i) a CDR1 having an amino acid sequence according to SEQ ID NO: 384; (ii) a CDR2 having an amino acid sequence according to SEQ ID NO: 490; and (iii) a CDR3 having an amino acid sequence according to SEQ ID NO: 596.

Embodiment 65. The α4β7 binding protein of embodiment 10, wherein the VH comprises (i) a CDR1 having an amino acid sequence according to SEQ ID NO: 67; (ii) a CDR2 having an amino acid sequence according to SEQ ID NO: 173; and (iii) a CDR3 having an amino acid sequence according to SEQ ID NO: 279; and the VL comprises (i) a CDR1 having an amino acid sequence according to SEQ ID NO: 385; (ii) a CDR2 having an amino acid sequence according to SEQ ID NO: 491; and (iii) a CDR3 having an amino acid sequence according to SEQ ID NO: 597. The α4β7 binding protein of embodiment 10, wherein the VH comprises (i) a CDR1 having an amino acid sequence according to SEQ ID NO: 68; (ii) a CDR2 having an amino acid sequence according to SEQ ID NO: 174; and (iii) a CDR3 having an amino acid sequence according to SEQ ID NO: 280; and the VL comprises (i) a CDR1 having an amino acid sequence according to SEQ ID NO: 386; (ii) a CDR2 having an amino acid sequence according to SEQ ID NO: 492; and (iii) a CDR3 having an amino acid sequence according to SEQ ID NO: 598.

Embodiment 66. The α4β7 binding protein of embodiment 10, wherein the VH comprises (i) a CDR1 having an amino acid sequence according to SEQ ID NO: 69; (ii) a CDR2 having an amino acid sequence according to SEQ ID NO: 175; and (iii) a CDR3 having an amino acid sequence according to SEQ ID NO: 281; and the VL comprises (i) a CDR1 having an amino acid sequence according to SEQ ID NO: 387; (ii) a CDR2 having an amino acid sequence according to SEQ ID NO: 493; and (iii) a CDR3 having an amino acid sequence according to SEQ ID NO: 599.

Embodiment 67. The α4β7 binding protein of embodiment 10, wherein the VH comprises (i) a CDR1 having an amino acid sequence according to SEQ ID NO: 70; (ii) a CDR2 having an amino acid sequence according to SEQ ID NO: 176; and (iii) a CDR3 having an amino acid sequence according to SEQ ID NO: 282; and the VL comprises (i) a CDR1 having an amino acid sequence according to SEQ ID NO: 388; (ii) a CDR2 having an amino acid sequence according to SEQ ID NO: 494; and (iii) a CDR3 having an amino acid sequence according to SEQ ID NO: 600.

Embodiment 68. The α4β7 binding protein of embodiment 10, wherein the VH comprises (i) a CDR1 having an amino acid sequence according to SEQ ID NO: 71; (ii) a CDR2 having an amino acid sequence according to SEQ ID NO: 177; and (iii) a CDR3 having an amino acid sequence according to SEQ ID NO: 283; and the VL comprises (i) a CDR1 having an amino acid sequence according to SEQ ID NO: 389; (ii) a CDR2 having an amino acid sequence according to SEQ ID NO: 495; and (iii) a CDR3 having an amino acid sequence according to SEQ ID NO: 601.

Embodiment 69. The α4β7 binding protein of embodiment 10, wherein the VH comprises (i) a CDR1 having an amino acid sequence according to SEQ ID NO: 72; (ii) a CDR2 having an amino acid sequence according to SEQ ID NO: 178; and (iii) a CDR3 having an amino acid sequence according to SEQ ID NO: 284; and the VL comprises (i) a CDR1 having an amino acid sequence according to SEQ ID NO: 390; (ii) a CDR2 having an amino acid sequence according to SEQ ID NO: 496; and (iii) a CDR3 having an amino acid sequence according to SEQ ID NO: 602.

Embodiment 70. The α4β7 binding protein of embodiment 10, wherein the VH comprises (i) a CDR1 having an amino acid sequence according to SEQ ID NO: 73; (ii) a CDR2 having an amino acid sequence according to SEQ ID NO: 179; and (iii) a CDR3 having an amino acid sequence according to SEQ ID NO: 285; and the VL comprises (i) a CDR1 having an amino acid sequence according to SEQ ID NO: 391; (ii) a CDR2 having an amino acid sequence according to SEQ ID NO: 497; and (iii) a CDR3 having an amino acid sequence according to SEQ ID NO: 603.

Embodiment 71. The α4β7 binding protein of embodiment 10, wherein the VH comprises (i) a CDR1 having an amino acid sequence according to SEQ ID NO: 74; (ii) a CDR2 having an amino acid sequence according to SEQ ID NO: 180; and (iii) a CDR3 having an amino acid sequence according to SEQ ID NO: 286; and the VL comprises (i) a CDR1 having an amino acid sequence according to SEQ ID NO: 392; (ii) a CDR2 having an amino acid sequence according to SEQ ID NO: 498; and (iii) a CDR3 having an amino acid sequence according to SEQ ID NO: 604.

Embodiment 72. The α4β7 binding protein of embodiment 10, wherein the VH comprises (i) a CDR1 having an amino acid sequence according to SEQ ID NO: 75; (ii) a CDR2 having an amino acid sequence according to SEQ ID NO: 181; and (iii) a CDR3 having an amino acid sequence according to SEQ ID NO: 287; and the VL comprises (i) a CDR1 having an amino acid sequence according to SEQ ID NO: 393; (ii) a CDR2 having an amino acid sequence according to SEQ ID NO: 499; and (iii) a CDR3 having an amino acid sequence according to SEQ ID NO: 605.

Embodiment 73. The α4β7 binding protein of embodiment 10, wherein the VH comprises (i) a CDR1 having an amino acid sequence according to SEQ ID NO: 76; (ii) a CDR2 having an amino acid sequence according to SEQ ID NO: 182; and (iii) a CDR3 having an amino acid sequence according to SEQ ID NO: 288; and the VL comprises (i) a CDR1 having an amino acid sequence according to SEQ ID NO: 394; (ii) a CDR2 having an amino acid sequence according to SEQ ID NO: 500; and (iii) a CDR3 having an amino acid sequence according to SEQ ID NO: 606.

Embodiment 74. The α4β7 binding protein of embodiment 10, wherein the VH comprises (i) a CDR1 having an amino acid sequence according to SEQ ID NO: 77; (ii) a CDR2 having an amino acid sequence according to SEQ ID NO: 183; and (iii) a CDR3 having an amino acid sequence according to SEQ ID NO: 289; and the VL comprises (i) a CDR1 having an amino acid sequence according to SEQ ID NO: 395; (ii) a CDR2 having an amino acid sequence according to SEQ ID NO: 501; and (iii) a CDR3 having an amino acid sequence according to SEQ ID NO: 607.

Embodiment 75. The α4β7 binding protein of embodiment 10, wherein the VH comprises (i) a CDR1 having an amino acid sequence according to SEQ ID NO: 78; (ii) a CDR2 having an amino acid sequence according to SEQ ID NO: 184; and (iii) a CDR3 having an amino acid sequence according to SEQ ID NO: 290; and the VL comprises (i) a CDR1 having an amino acid sequence according to SEQ ID NO: 396; (ii) a CDR2 having an amino acid sequence according to SEQ ID NO: 502; and (iii) a CDR3 having an amino acid sequence according to SEQ ID NO: 608.

Embodiment 76. The α4β7 binding protein of embodiment 10, wherein the VH comprises (i) a CDR1 having an amino acid sequence according to SEQ ID NO: 79; (ii) a CDR2 having an amino acid sequence according to SEQ ID NO: 185; and (iii) a CDR3 having an amino acid sequence according to SEQ ID NO: 291; and the VL comprises (i) a CDR1 having an amino acid sequence according to SEQ ID NO: 397; (ii) a CDR2 having an amino acid sequence according to SEQ ID NO: 503; and (iii) a CDR3 having an amino acid sequence according to SEQ ID NO: 609.

Embodiment 77. The α4β7 binding protein of embodiment 10, wherein the VH comprises (i) a CDR1 having an amino acid sequence according to SEQ ID NO: 80; (ii) a CDR2 having an amino acid sequence according to SEQ ID NO: 186; and (iii) a CDR3 having an amino acid sequence according to SEQ ID NO: 292; and the VL comprises (i) a CDR1 having an amino acid sequence according to SEQ ID NO: 398; (ii) a CDR2 having an amino acid sequence according to SEQ ID NO: 504; and (iii) a CDR3 having an amino acid sequence according to SEQ ID NO: 610.

Embodiment 78. The α4β7 binding protein of embodiment 10, wherein the VH comprises (i) a CDR1 having an amino acid sequence according to SEQ ID NO: 84; (ii) a CDR2 having an amino acid sequence according to SEQ ID NO: 190; and (iii) a CDR3 having an amino acid sequence according to SEQ ID NO: 296; and the VL comprises (i) a CDR1 having an amino acid sequence according to SEQ ID NO: 402; (ii) a CDR2 having an amino acid sequence according to SEQ ID NO: 508; and (iii) a CDR3 having an amino acid sequence according to SEQ ID NO: 614.

Embodiment 79. The α4β7 binding protein of embodiment 10, wherein the VH comprises (i) a CDR1 having an amino acid sequence according to SEQ ID NO: 85; (ii) a CDR2 having an amino acid sequence according to SEQ ID NO: 191; and (iii) a CDR3 having an amino acid sequence according to SEQ ID NO: 297; and the VL comprises (i) a CDR1 having an amino acid sequence according to SEQ ID NO: 403; (ii) a CDR2 having an amino acid sequence according to SEQ ID NO: 509; and (iii) a CDR3 having an amino acid sequence according to SEQ ID NO: 615.

Embodiment 80. The α4β7 binding protein of embodiment 10, wherein the VH comprises (i) a CDR1 having an amino acid sequence according to SEQ ID NO: 86; (ii) a CDR2 having an amino acid sequence according to SEQ ID NO: 192; and (iii) a CDR3 having an amino acid sequence according to SEQ ID NO: 298; and the VL comprises (i) a CDR1 having an amino acid sequence according to SEQ ID NO: 404; (ii) a CDR2 having an amino acid sequence according to SEQ ID NO: 510; and (iii) a CDR3 having an amino acid sequence according to SEQ ID NO: 616.

Embodiment 81. The α4β7 binding protein of embodiment 10, wherein the VH comprises (i) a CDR1 having an amino acid sequence according to SEQ ID NO: 87; (ii) a CDR2 having an amino acid sequence according to SEQ ID NO: 193; and (iii) a CDR3 having an amino acid sequence according to SEQ ID NO: 299; and the VL comprises (i) a CDR1 having an amino acid sequence according to SEQ ID NO: 405; (ii) a CDR2 having an amino acid sequence according to SEQ ID NO: 511; and (iii) a CDR3 having an amino acid sequence according to SEQ ID NO: 617.

Embodiment 82. The α4β7 binding protein of embodiment 10, wherein the VH comprises (i) a CDR1 having an amino acid sequence according to SEQ ID NO: 88; (ii) a CDR2 having an amino acid sequence according to SEQ ID NO: 194; and (iii) a CDR3 having an amino acid sequence according to SEQ ID NO: 300; and the VL comprises (i) a CDR1 having an amino acid sequence according to SEQ ID NO: 406; (ii) a CDR2 having an amino acid sequence according to SEQ ID NO: 512; and (iii) a CDR3 having an amino acid sequence according to SEQ ID NO: 618.

Embodiment 83. The α4β7 binding protein of embodiment 10, wherein the VH comprises (i) a CDR1 having an amino acid sequence according to SEQ ID NO: 89; (ii) a CDR2 having an amino acid sequence according to SEQ ID NO: 195; and (iii) a CDR3 having an amino acid sequence according to SEQ ID NO: 301; and the VL comprises (i) a CDR1 having an amino acid sequence according to SEQ ID NO: 407; (ii) a CDR2 having an amino acid sequence according to SEQ ID NO: 513; and (iii) a CDR3 having an amino acid sequence according to SEQ ID NO: 619.

Embodiment 84. The α4β7 binding protein of embodiment 10, wherein the VH comprises (i) a CDR1 having an amino acid sequence according to SEQ ID NO: 90; (ii) a CDR2 having an amino acid sequence according to SEQ ID NO: 196; and (iii) a CDR3 having an amino acid sequence according to SEQ ID NO: 302; and the VL comprises (i) a CDR1 having an amino acid sequence according to SEQ ID NO: 408; (ii) a CDR2 having an amino acid sequence according to SEQ ID NO: 514; and (iii) a CDR3 having an amino acid sequence according to SEQ ID NO: 620.

Embodiment 85. The α4β7 binding protein of embodiment 10, wherein the VH comprises (i) a CDR1 having an amino acid sequence according to SEQ ID NO: 91; (ii) a CDR2 having an amino acid sequence according to SEQ ID NO: 197; and (iii) a CDR3 having an amino acid sequence according to SEQ ID NO: 303; and the VL comprises (i) a CDR1 having an amino acid sequence according to SEQ ID NO: 409; (ii) a CDR2 having an amino acid sequence according to SEQ ID NO: 515; and (iii) a CDR3 having an amino acid sequence according to SEQ ID NO: 621.

Embodiment 86. The α4β7 binding protein of embodiment 10, wherein the VH comprises (i) a CDR1 having an amino acid sequence according to SEQ ID NO: 92; (ii) a CDR2 having an amino acid sequence according to SEQ ID NO: 198; and (iii) a CDR3 having an amino acid sequence according to SEQ ID NO: 304; and the VL comprises (i) a CDR1 having an amino acid sequence according to SEQ ID NO: 410; (ii) a CDR2 having an amino acid sequence according to SEQ ID NO: 516; and (iii) a CDR3 having an amino acid sequence according to SEQ ID NO: 622.

Embodiment 87. The α4β7 binding protein of embodiment 10, wherein the VH comprises (i) a CDR1 having an amino acid sequence according to SEQ ID NO: 93; (ii) a CDR2 having an amino acid sequence according to SEQ ID NO: 199; and (iii) a CDR3 having an amino acid sequence according to SEQ ID NO: 305; and the VL comprises (i) a CDR1 having an amino acid sequence according to SEQ ID NO: 411; (ii) a CDR2 having an amino acid sequence according to SEQ ID NO: 517; and (iii) a CDR3 having an amino acid sequence according to SEQ ID NO: 623.

Embodiment 88. The α4β7 binding protein of embodiment 10, wherein the VH comprises (i) a CDR1 having an amino acid sequence according to SEQ ID NO: 94; (ii) a CDR2 having an amino acid sequence according to SEQ ID NO: 200; and (iii) a CDR3 having an amino acid sequence according to SEQ ID NO: 306; and the VL comprises (i) a CDR1 having an amino acid sequence according to SEQ ID NO: 412; (ii) a CDR2 having an amino acid sequence according to SEQ ID NO: 518; and (iii) a CDR3 having an amino acid sequence according to SEQ ID NO: 624.

Embodiment 89. The α4β7 binding protein of embodiment 10, wherein the VH comprises (i) a CDR1 having an amino acid sequence according to SEQ ID NO: 95; (ii) a CDR2 having an amino acid sequence according to SEQ ID NO: 201; and (iii) a CDR3 having an amino acid sequence according to SEQ ID NO: 307; and the VL comprises (i) a CDR1 having an amino acid sequence according to SEQ ID NO: 413; (ii) a CDR2 having an amino acid sequence according to SEQ ID NO: 519; and (iii) a CDR3 having an amino acid sequence according to SEQ ID NO: 625.

Embodiment 90. The α4β7 binding protein of embodiment 10, wherein the VH comprises (i) a CDR1 having an amino acid sequence according to SEQ ID NO: 96; (ii) a CDR2 having an amino acid sequence according to SEQ ID NO: 202; and (iii) a CDR3 having an amino acid sequence according to SEQ ID NO: 308; and the VL comprises (i) a CDR1 having an amino acid sequence according to SEQ ID NO: 414; (ii) a CDR2 having an amino acid sequence according to SEQ ID NO: 520; and (iii) a CDR3 having an amino acid sequence according to SEQ ID NO: 626.

Embodiment 91. The α4β7 binding protein of embodiment 10, wherein the VH comprises (i) a CDR1 having an amino acid sequence according to SEQ ID NO: 97; (ii) a CDR2 having an amino acid sequence according to SEQ ID NO: 203; and (iii) a CDR3 having an amino acid sequence according to SEQ ID NO: 309; and the VL comprises (i) a CDR1 having an amino acid sequence according to SEQ ID NO: 415; (ii) a CDR2 having an amino acid sequence according to SEQ ID NO: 521; and (iii) a CDR3 having an amino acid sequence according to SEQ ID NO: 627.

Embodiment 92. The α4β7 binding protein of embodiment 10, wherein the VH comprises (i) a CDR1 having an amino acid sequence according to SEQ ID NO: 98; (ii) a CDR2 having an amino acid sequence according to SEQ ID NO: 204; and (iii) a CDR3 having an amino acid sequence according to SEQ ID NO: 310; and the VL comprises (i) a CDR1 having an amino acid sequence according to SEQ ID NO: 416; (ii) a CDR2 having an amino acid sequence according to SEQ ID NO: 522; and (iii) a CDR3 having an amino acid sequence according to SEQ ID NO: 628.

Embodiment 93. The α4β7 binding protein of embodiment 10, wherein the VH comprises (i) a CDR1 having an amino acid sequence according to SEQ ID NO: 99; (ii) a CDR2 having an amino acid sequence according to SEQ ID NO: 205; and (iii) a CDR3 having an amino acid sequence according to SEQ ID NO: 311; and the VL comprises (i) a CDR1 having an amino acid sequence according to SEQ ID NO: 417; (ii) a CDR2 having an amino acid sequence according to SEQ ID NO: 523; and (iii) a CDR3 having an amino acid sequence according to SEQ ID NO: 629.

Embodiment 94. The α4β7 binding protein of embodiment 10, wherein the VH comprises (i) a CDR1 having an amino acid sequence according to SEQ ID NO: 100; (ii) a CDR2 having an amino acid sequence according to SEQ ID NO: 206; and (iii) a CDR3 having an amino acid sequence according to SEQ ID NO: 312; and the VL comprises (i) a CDR1 having an amino acid sequence according to SEQ ID NO: 418; (ii) a CDR2 having an amino acid sequence according to SEQ ID NO: 524; and (iii) a CDR3 having an amino acid sequence according to SEQ ID NO: 630.

Embodiment 95. The α4β7 binding protein of embodiment 10, wherein the VH comprises (i) a CDR1 having an amino acid sequence according to SEQ ID NO: 101; (ii) a CDR2 having an amino acid sequence according to SEQ ID NO: 207; and (iii) a CDR3 having an amino acid sequence according to SEQ ID NO: 313; and the VL comprises (i) a CDR1 having an amino acid sequence according to SEQ ID NO: 419; (ii) a CDR2 having an amino acid sequence according to SEQ ID NO: 525; and (iii) a CDR3 having an amino acid sequence according to SEQ ID NO: 631.

Embodiment 96. The α4β7 binding protein of embodiment 10, wherein the VH comprises (i) a CDR1 having an amino acid sequence according to SEQ ID NO: 102; (ii) a CDR2 having an amino acid sequence according to SEQ ID NO: 208; and (iii) a CDR3 having an amino acid sequence according to SEQ ID NO: 314; and the VL comprises (i) a CDR1 having an amino acid sequence according to SEQ ID NO: 420; (ii) a CDR2 having an amino acid sequence according to SEQ ID NO: 526; and (iii) a CDR3 having an amino acid sequence according to SEQ ID NO: 632.

Embodiment 97. The α4β7 binding protein of embodiment 10, wherein the VH comprises (i) a CDR1 having an amino acid sequence according to SEQ ID NO: 103; (ii) a CDR2 having an amino acid sequence according to SEQ ID NO: 209; and (iii) a CDR3 having an amino acid sequence according to SEQ ID NO: 315; and the VL comprises (i) a CDR1 having an amino acid sequence according to SEQ ID NO: 421; (ii) a CDR2 having an amino acid sequence according to SEQ ID NO: 527; and (iii) a CDR3 having an amino acid sequence according to SEQ ID NO: 633.

Embodiment 98. The α4β7 binding protein of embodiment 10, wherein the VH comprises (i) a CDR1 having an amino acid sequence according to SEQ ID NO: 104; (ii) a CDR2 having an amino acid sequence according to SEQ ID NO: 210; and (iii) a CDR3 having an amino acid sequence according to SEQ ID NO: 316; and the VL comprises (i) a CDR1 having an amino acid sequence according to SEQ ID NO: 422; (ii) a CDR2 having an amino acid sequence according to SEQ ID NO: 528; and (iii) a CDR3 having an amino acid sequence according to SEQ ID NO: 634.

Embodiment 99. The α4β7 binding protein of embodiment 10, wherein the VH comprises (i) a CDR1 having an amino acid sequence according to SEQ ID NO: 105; (ii) a CDR2 having an amino acid sequence according to SEQ ID NO: 211; and (iii) a CDR3 having an amino acid sequence according to SEQ ID NO: 317; and the VL comprises (i) a CDR1 having an amino acid sequence according to SEQ ID NO: 423; (ii) a CDR2 having an amino acid sequence according to SEQ ID NO: 529; and (iii) a CDR3 having an amino acid sequence according to SEQ ID NO: 635.

Embodiment 100. The α4β7 binding protein of embodiment 10, wherein the VH comprises (i) a CDR1 having an amino acid sequence according to SEQ ID NO: 106; (ii) a CDR2 having an amino acid sequence according to SEQ ID NO: 212; and (iii) a CDR3 having an amino acid sequence according to SEQ ID NO: 318; and the VL comprises (i) a CDR1 having an amino acid sequence according to SEQ ID NO: 424; (ii) a CDR2 having an amino acid sequence according to SEQ ID NO: 530; and (iii) a CDR3 having an amino acid sequence according to SEQ ID NO: 636.

Embodiment 101. The α4β7 binding protein of any one of embodiments 10-100, wherein the VH comprises a sequence having at least 80% sequence identity to the amino acid sequence of any one of SEQ ID NOs: 1915-1934, 1940-1966, 1968-1988, and 1992-2014; and the VL comprises a sequence having at least 80% sequence identity to the amino acid sequence of any one of SEQ ID NOs: 2021-2040, 2046-2072, 2074-2094, and 2098-2120.

Embodiment 102. The α4β7 binding protein of embodiment 101, wherein the VH comprises a sequence having at least 80% sequence identity to the amino acid sequence of SEQ ID NO: 127 and the VL comprises a sequence having at least 80% sequence identity to the amino acid sequence of SEQ ID NO: 134.

Embodiment 103. The α4β7 binding protein of embodiment 101, wherein the VH comprises a sequence having at least 80% sequence identity to the amino acid sequence of SEQ ID NO: 1915 and the VL comprises a sequence having at least 80% sequence identity to the amino acid sequence of SEQ ID NO: 2021.

Embodiment 104. The α4β7 binding protein of embodiment 101, wherein the VH comprises a sequence having at least 80% sequence identity to the amino acid sequence of SEQ ID NO: 1916 and the VL comprises a sequence having at least 80% sequence identity to the amino acid sequence of SEQ ID NO: 2022.

Embodiment 105. The α4β7 binding protein of embodiment 101, wherein the VH comprises a sequence having at least 80% sequence identity to the amino acid sequence of SEQ ID NO: 1917 and the VL comprises a sequence having at least 80% sequence identity to the amino acid sequence of SEQ ID NO: 2023.

Embodiment 106. The α4β7 binding protein of embodiment 101, wherein the VH comprises a sequence having at least 80% sequence identity to the amino acid sequence of SEQ ID NO: 1918 and the VL comprises a sequence having at least 80% sequence identity to the amino acid sequence of SEQ ID NO: 2024.

Embodiment 107. The α4β7 binding protein of embodiment 101, wherein the VH comprises a sequence having at least 80% sequence identity to the amino acid sequence of SEQ ID NO: 1919 and the VL comprises a sequence having at least 80% sequence identity to the amino acid sequence of SEQ ID NO: 2025.

Embodiment 108. The α4β7 binding protein of embodiment 101, wherein the VH comprises a sequence having at least 80% sequence identity to the amino acid sequence of SEQ ID NO: 1920 and the VL comprises a sequence having at least 80% sequence identity to the amino acid sequence of SEQ ID NO: 2026.

Embodiment 109. The α4β7 binding protein of embodiment 101, wherein the VH comprises a sequence having at least 80% sequence identity to the amino acid sequence of SEQ ID NO: 1921 and the VL comprises a sequence having at least 80% sequence identity to the amino acid sequence of SEQ ID NO: 2027.

Embodiment 110. The α4β7 binding protein of embodiment 101, wherein the VH comprises a sequence having at least 80% sequence identity to the amino acid sequence of SEQ ID NO: 1922 and the VL comprises a sequence having at least 80% sequence identity to the amino acid sequence of SEQ ID NO: 2028.

Embodiment 111. The α4β7 binding protein of embodiment 101, wherein the VH comprises a sequence having at least 80% sequence identity to the amino acid sequence of SEQ ID NO: 1923 and the VL comprises a sequence having at least 80% sequence identity to the amino acid sequence of SEQ ID NO: 2029.

Embodiment 112. The α4β7 binding protein of embodiment 101, wherein the VH comprises a sequence having at least 80% sequence identity to the amino acid sequence of SEQ ID NO: 1924 and the VL comprises a sequence having at least 80% sequence identity to the amino acid sequence of SEQ ID NO: 2030.

Embodiment 113. The α4β7 binding protein of embodiment 101, wherein the VH comprises a sequence having at least 80% sequence identity to the amino acid sequence of SEQ ID NO: 1925 and the VL comprises a sequence having at least 80% sequence identity to the amino acid sequence of SEQ ID NO: 2031.

Embodiment 114. The α4β7 binding protein of embodiment 101, wherein the VH comprises a sequence having at least 80% sequence identity to the amino acid sequence of SEQ ID NO: 1926 and the VL comprises a sequence having at least 80% sequence identity to the amino acid sequence of SEQ ID NO: 2032.

Embodiment 115. The α4β7 binding protein of embodiment 101, wherein the VH comprises a sequence having at least 80% sequence identity to the amino acid sequence of SEQ ID NO: 1927 and the VL comprises a sequence having at least 80% sequence identity to the amino acid sequence of SEQ ID NO: 2033.

Embodiment 116. The α4β7 binding protein of embodiment 101, wherein the VH comprises a sequence having at least 80% sequence identity to the amino acid sequence of SEQ ID NO: 1928 and the VL comprises a sequence having at least 80% sequence identity to the amino acid sequence of SEQ ID NO: 2034.

Embodiment 117. The α4β7 binding protein of embodiment 101, wherein the VH comprises a sequence having at least 80% sequence identity to the amino acid sequence of SEQ ID NO: 1929 and the VL comprises a sequence having at least 80% sequence identity to the amino acid sequence of SEQ ID NO: 2035.

Embodiment 118. The α4β7 binding protein of embodiment 101, wherein the VH comprises a sequence having at least 80% sequence identity to the amino acid sequence of SEQ ID NO: 1930 and the VL comprises a sequence having at least 80% sequence identity to the amino acid sequence of SEQ ID NO: 2036.

Embodiment 119. The α4β7 binding protein of embodiment 101, wherein the VH comprises a sequence having at least 80% sequence identity to the amino acid sequence of SEQ ID NO: 1931 and the VL comprises a sequence having at least 80% sequence identity to the amino acid sequence of SEQ ID NO: 2037.

Embodiment 120. The α4β7 binding protein of embodiment 101, wherein the VH comprises a sequence having at least 80% sequence identity to the amino acid sequence of SEQ ID NO: 1932 and the VL comprises a sequence having at least 80% sequence identity to the amino acid sequence of SEQ ID NO: 2038.

Embodiment 121. The α4β7 binding protein of embodiment 101, wherein the VH comprises a sequence having at least 80% sequence identity to the amino acid sequence of SEQ ID NO: 1933 and the VL comprises a sequence having at least 80% sequence identity to the amino acid sequence of SEQ ID NO: 2039.

Embodiment 122. The α4β7 binding protein of embodiment 101, wherein the VH comprises a sequence having at least 80% sequence identity to the amino acid sequence of SEQ ID NO: 1934 and the VL comprises a sequence having at least 80% sequence identity to the amino acid sequence of SEQ ID NO: 2040.

Embodiment 123. The α4β7 binding protein of embodiment 101, wherein the VH comprises a sequence having at least 80% sequence identity to the amino acid sequence of SEQ ID NO: 1940 and the VL comprises a sequence having at least 80% sequence identity to the amino acid sequence of SEQ ID NO: 2046.

Embodiment 124. The α4β7 binding protein of embodiment 101, wherein the VH comprises a sequence having at least 80% sequence identity to the amino acid sequence of SEQ ID NO: 1941 and the VL comprises a sequence having at least 80% sequence identity to the amino acid sequence of SEQ ID NO: 2047.

Embodiment 125. The α4β7 binding protein of embodiment 101, wherein the VH comprises a sequence having at least 80% sequence identity to the amino acid sequence of SEQ ID NO: 1942 and the VL comprises a sequence having at least 80% sequence identity to the amino acid sequence of SEQ ID NO: 2048.

Embodiment 126. The α4β7 binding protein of embodiment 101, wherein the VH comprises a sequence having at least 80% sequence identity to the amino acid sequence of SEQ ID NO: 1943 and the VL comprises a sequence having at least 80% sequence identity to the amino acid sequence of SEQ ID NO: 2049.

Embodiment 127. The α4β7 binding protein of embodiment 101, wherein the VH comprises a sequence having at least 80% sequence identity to the amino acid sequence of SEQ ID NO: 1944 and the VL comprises a sequence having at least 80% sequence identity to the amino acid sequence of SEQ ID NO: 2050.

Embodiment 128. The α4β7 binding protein of embodiment 101, wherein the VH comprises a sequence having at least 80% sequence identity to the amino acid sequence of SEQ ID NO: 1945 and the VL comprises a sequence having at least 80% sequence identity to the amino acid sequence of SEQ ID NO: 2051.

Embodiment 129. The α4β7 binding protein of embodiment 101, wherein the VH comprises a sequence having at least 80% sequence identity to the amino acid sequence of SEQ ID NO: 1946 and the VL comprises a sequence having at least 80% sequence identity to the amino acid sequence of SEQ ID NO: 2052.

Embodiment 130. The α4β7 binding protein of embodiment 101, wherein the VH comprises a sequence having at least 80% sequence identity to the amino acid sequence of SEQ ID NO: 1947 and the VL comprises a sequence having at least 80% sequence identity to the amino acid sequence of SEQ ID NO: 2053.

Embodiment 131. The α4β7 binding protein of embodiment 101, wherein the VH comprises a sequence having at least 80% sequence identity to the amino acid sequence of SEQ ID NO: 1948 and the VL comprises a sequence having at least 80% sequence identity to the amino acid sequence of SEQ ID NO: 2054.

Embodiment 132. The α4β7 binding protein of embodiment 101, wherein the VH comprises a sequence having at least 80% sequence identity to the amino acid sequence of SEQ ID NO: 1949 and the VL comprises a sequence having at least 80% sequence identity to the amino acid sequence of SEQ ID NO: 2055.

Embodiment 133. The α4β7 binding protein of embodiment 101, wherein the VH comprises a sequence having at least 80% sequence identity to the amino acid sequence of SEQ ID NO: 1950 and the VL comprises a sequence having at least 80% sequence identity to the amino acid sequence of SEQ ID NO: 2056.

Embodiment 134. The α4β7 binding protein of embodiment 101, wherein the VH comprises a sequence having at least 80% sequence identity to the amino acid sequence of SEQ ID NO: 1951 and the VL comprises a sequence having at least 80% sequence identity to the amino acid sequence of SEQ ID NO: 2057.

Embodiment 135. The α4β7 binding protein of embodiment 101, wherein the VH comprises a sequence having at least 80% sequence identity to the amino acid sequence of SEQ ID NO: 1952 and the VL comprises a sequence having at least 80% sequence identity to the amino acid sequence of SEQ ID NO: 2058.

Embodiment 136. The α4β7 binding protein of embodiment 101, wherein the VH comprises a sequence having at least 80% sequence identity to the amino acid sequence of SEQ ID NO: 1953 and the VL comprises a sequence having at least 80% sequence identity to the amino acid sequence of SEQ ID NO: 2059.

Embodiment 137. The α4β7 binding protein of embodiment 101, wherein the VH comprises a sequence having at least 80% sequence identity to the amino acid sequence of SEQ ID NO: 1954 and the VL comprises a sequence having at least 80% sequence identity to the amino acid sequence of SEQ ID NO: 2060.

Embodiment 138. The α4β7 binding protein of embodiment 101, wherein the VH comprises a sequence having at least 80% sequence identity to the amino acid sequence of SEQ ID NO: 1955 and the VL comprises a sequence having at least 80% sequence identity to the amino acid sequence of SEQ ID NO: 2061.

Embodiment 139. The α4β7 binding protein of embodiment 101, wherein the VH comprises a sequence having at least 80% sequence identity to the amino acid sequence of SEQ ID NO: 1956 and the VL comprises a sequence having at least 80% sequence identity to the amino acid sequence of SEQ ID NO: 2062.

Embodiment 140. The α4β7 binding protein of embodiment 101, wherein the VH comprises a sequence having at least 80% sequence identity to the amino acid sequence of SEQ ID NO: 1957 and the VL comprises a sequence having at least 80% sequence identity to the amino acid sequence of SEQ ID NO: 2063.

Embodiment 141. The α4β7 binding protein of embodiment 101, wherein the VH comprises a sequence having at least 80% sequence identity to the amino acid sequence of SEQ ID NO: 1958 and the VL comprises a sequence having at least 80% sequence identity to the amino acid sequence of SEQ ID NO: 2064.

Embodiment 142. The α4β7 binding protein of embodiment 101, wherein the VH comprises a sequence having at least 80% sequence identity to the amino acid sequence of SEQ ID NO: 1959 and the VL comprises a sequence having at least 80% sequence identity to the amino acid sequence of SEQ ID NO: 2065.

Embodiment 143. The α4β7 binding protein of embodiment 101, wherein the VH comprises a sequence having at least 80% sequence identity to the amino acid sequence of SEQ ID NO: 1960 and the VL comprises a sequence having at least 80% sequence identity to the amino acid sequence of SEQ ID NO: 2066.

Embodiment 144. The α4β7 binding protein of embodiment 101, wherein the VH comprises a sequence having at least 80% sequence identity to the amino acid sequence of SEQ ID NO: 1961 and the VL comprises a sequence having at least 80% sequence identity to the amino acid sequence of SEQ ID NO: 2067.

Embodiment 145. The α4β7 binding protein of embodiment 101, wherein the VH comprises a sequence having at least 80% sequence identity to the amino acid sequence of SEQ ID NO: 1962 and the VL comprises a sequence having at least 80% sequence identity to the amino acid sequence of SEQ ID NO: 2068.

Embodiment 146. The α4β7 binding protein of embodiment 101, wherein the VH comprises a sequence having at least 80% sequence identity to the amino acid sequence of SEQ ID NO: 1963 and the VL comprises a sequence having at least 80% sequence identity to the amino acid sequence of SEQ ID NO: 2069.

Embodiment 147. The α4β7 binding protein of embodiment 101, wherein the VH comprises a sequence having at least 80% sequence identity to the amino acid sequence of SEQ ID NO: 1964 and the VL comprises a sequence having at least 80% sequence identity to the amino acid sequence of SEQ ID NO: 2070.

Embodiment 148. The α4β7 binding protein of embodiment 101, wherein the VH comprises a sequence having at least 80% sequence identity to the amino acid sequence of SEQ ID NO: 1965 and the VL comprises a sequence having at least 80% sequence identity to the amino acid sequence of SEQ ID NO: 2071.

Embodiment 149. The α4β7 binding protein of embodiment 101, wherein the VH comprises a sequence having at least 80% sequence identity to the amino acid sequence of SEQ ID NO: 1966 and the VL comprises a sequence having at least 80% sequence identity to the amino acid sequence of SEQ ID NO: 2072.

Embodiment 150. The α4β7 binding protein of embodiment 101, wherein the VH comprises a sequence having at least 80% sequence identity to the amino acid sequence of SEQ ID NO: 1968 and the VL comprises a sequence having at least 80% sequence identity to the amino acid sequence of SEQ ID NO: 2074.

Embodiment 151. The α4β7 binding protein of embodiment 101, wherein the VH comprises a sequence having at least 80% sequence identity to the amino acid sequence of SEQ ID NO: 1969 and the VL comprises a sequence having at least 80% sequence identity to the amino acid sequence of SEQ ID NO: 2075.

Embodiment 152. The α4β7 binding protein of embodiment 101, wherein the VH comprises a sequence having at least 80% sequence identity to the amino acid sequence of SEQ ID NO: 1970 and the VL comprises a sequence having at least 80% sequence identity to the amino acid sequence of SEQ ID NO: 2076.

Embodiment 153. The α4β7 binding protein of embodiment 101, wherein the VH comprises a sequence having at least 80% sequence identity to the amino acid sequence of SEQ ID NO: 1971 and the VL comprises a sequence having at least 80% sequence identity to the amino acid sequence of SEQ ID NO: 2077.

Embodiment 154. The α4β7 binding protein of embodiment 101, wherein the VH comprises a sequence having at least 80% sequence identity to the amino acid sequence of SEQ ID NO: 1972 and the VL comprises a sequence having at least 80% sequence identity to the amino acid sequence of SEQ ID NO: 2078.

Embodiment 155. The α4β7 binding protein of embodiment 101, wherein the VH comprises a sequence having at least 80% sequence identity to the amino acid sequence of SEQ ID NO: 1973 and the VL comprises a sequence having at least 80% sequence identity to the amino acid sequence of SEQ ID NO: 2079.

Embodiment 156. The α4β7 binding protein of embodiment 101, wherein the VH comprises a sequence having at least 80% sequence identity to the amino acid sequence of SEQ ID NO: 1974 and the VL comprises a sequence having at least 80% sequence identity to the amino acid sequence of SEQ ID NO: 2080.

Embodiment 157. The α4β7 binding protein of embodiment 101, wherein the VH comprises a sequence having at least 80% sequence identity to the amino acid sequence of SEQ ID NO: 1975 and the VL comprises a sequence having at least 80% sequence identity to the amino acid sequence of SEQ ID NO: 2081.

Embodiment 158. The α4β7 binding protein of embodiment 101, wherein the VH comprises a sequence having at least 80% sequence identity to the amino acid sequence of SEQ ID NO: 1976 and the VL comprises a sequence having at least 80% sequence identity to the amino acid sequence of SEQ ID NO: 2082.

Embodiment 159. The α4β7 binding protein of embodiment 101, wherein the VH comprises a sequence having at least 80% sequence identity to the amino acid sequence of SEQ ID NO: 1977 and the VL comprises a sequence having at least 80% sequence identity to the amino acid sequence of SEQ ID NO: 2083.

Embodiment 160. The α4β7 binding protein of embodiment 101, wherein the VH comprises a sequence having at least 80% sequence identity to the amino acid sequence of SEQ ID NO: 1978 and the VL comprises a sequence having at least 80% sequence identity to the amino acid sequence of SEQ ID NO: 2084.

Embodiment 161. The α4β7 binding protein of embodiment 101, wherein the VH comprises a sequence having at least 80% sequence identity to the amino acid sequence of SEQ ID NO: 1979 and the VL comprises a sequence having at least 80% sequence identity to the amino acid sequence of SEQ ID NO: 2085.

Embodiment 162. The α4β7 binding protein of embodiment 101, wherein the VH comprises a sequence having at least 80% sequence identity to the amino acid sequence of SEQ ID NO: 1980 and the VL comprises a sequence having at least 80% sequence identity to the amino acid sequence of SEQ ID NO: 2086.

Embodiment 163. The α4β7 binding protein of embodiment 101, wherein the VH comprises a sequence having at least 80% sequence identity to the amino acid sequence of SEQ ID NO: 1981 and the VL comprises a sequence having at least 80% sequence identity to the amino acid sequence of SEQ ID NO: 2087.

Embodiment 164. The α4β7 binding protein of embodiment 101, wherein the VH comprises a sequence having at least 80% sequence identity to the amino acid sequence of SEQ ID NO: 1982 and the VL comprises a sequence having at least 80% sequence identity to the amino acid sequence of SEQ ID NO: 2088.

Embodiment 165. The α4β7 binding protein of embodiment 101, wherein the VH comprises a sequence having at least 80% sequence identity to the amino acid sequence of SEQ ID NO: 1983 and the VL comprises a sequence having at least 80% sequence identity to the amino acid sequence of SEQ ID NO: 2089.

Embodiment 166. The α4β7 binding protein of embodiment 101, wherein the VH comprises a sequence having at least 80% sequence identity to the amino acid sequence of SEQ ID NO: 1984 and the VL comprises a sequence having at least 80% sequence identity to the amino acid sequence of SEQ ID NO: 2090.

Embodiment 167. The α4β7 binding protein of embodiment 101, wherein the VH comprises a sequence having at least 80% sequence identity to the amino acid sequence of SEQ ID NO: 1985 and the VL comprises a sequence having at least 80% sequence identity to the amino acid sequence of SEQ ID NO: 2091.

Embodiment 168. The α4β7 binding protein of embodiment 101, wherein the VH comprises a sequence having at least 80% sequence identity to the amino acid sequence of SEQ ID NO: 1986 and the VL comprises a sequence having at least 80% sequence identity to the amino acid sequence of SEQ ID NO: 2092.

Embodiment 169. The α4β7 binding protein of embodiment 101, wherein the VH comprises a sequence having at least 80% sequence identity to the amino acid sequence of SEQ ID NO: 1987 and the VL comprises a sequence having at least 80% sequence identity to the amino acid sequence of SEQ ID NO: 2093.

Embodiment 170. The α4β7 binding protein of embodiment 101, wherein the VH comprises a sequence having at least 80% sequence identity to the amino acid sequence of SEQ ID NO: 1992 and the VL comprises a sequence having at least 80% sequence identity to the amino acid sequence of SEQ ID NO: 2098.

Embodiment 171. The α4β7 binding protein of embodiment 101, wherein the VH comprises a sequence having at least 80% sequence identity to the amino acid sequence of SEQ ID NO: 1993 and the VL comprises a sequence having at least 80% sequence identity to the amino acid sequence of SEQ ID NO: 2099.

Embodiment 172. The α4β7 binding protein of embodiment 101, wherein the VH comprises a sequence having at least 80% sequence identity to the amino acid sequence of SEQ ID NO: 1994 and the VL comprises a sequence having at least 80% sequence identity to the amino acid sequence of SEQ ID NO: 2100.

Embodiment 173. The α4β7 binding protein of embodiment 101, wherein the VH comprises a sequence having at least 80% sequence identity to the amino acid sequence of SEQ ID NO: 1995 and the VL comprises a sequence having at least 80% sequence identity to the amino acid sequence of SEQ ID NO: 2101.

Embodiment 174. The α4β7 binding protein of embodiment 101, wherein the VH comprises a sequence having at least 80% sequence identity to the amino acid sequence of SEQ ID NO: 1996 and the VL comprises a sequence having at least 80% sequence identity to the amino acid sequence of SEQ ID NO: 2102.

Embodiment 175. The α4β7 binding protein of embodiment 101, wherein the VH comprises a sequence having at least 80% sequence identity to the amino acid sequence of SEQ ID NO: 1997 and the VL comprises a sequence having at least 80% sequence identity to the amino acid sequence of SEQ ID NO: 2103.

Embodiment 176. The α4β7 binding protein of embodiment 101, wherein the VH comprises a sequence having at least 80% sequence identity to the amino acid sequence of SEQ ID NO: 1998 and the VL comprises a sequence having at least 80% sequence identity to the amino acid sequence of SEQ ID NO: 2104.

Embodiment 177. The α4β7 binding protein of embodiment 101, wherein the VH comprises a sequence having at least 80% sequence identity to the amino acid sequence of SEQ ID NO: 1999 and the VL comprises a sequence having at least 80% sequence identity to the amino acid sequence of SEQ ID NO: 2105.

Embodiment 178. The α4β7 binding protein of embodiment 101, wherein the VH comprises a sequence having at least 80% sequence identity to the amino acid sequence of SEQ ID NO: 2000 and the VL comprises a sequence having at least 80% sequence identity to the amino acid sequence of SEQ ID NO: 2106.

Embodiment 179. The α4β7 binding protein of embodiment 101, wherein the VH comprises a sequence having at least 80% sequence identity to the amino acid sequence of SEQ ID NO: 2001 and the VL comprises a sequence having at least 80% sequence identity to the amino acid sequence of SEQ ID NO: 2107.

Embodiment 180. The α4β7 binding protein of embodiment 101, wherein the VH comprises a sequence having at least 80% sequence identity to the amino acid sequence of SEQ ID NO: 2002 and the VL comprises a sequence having at least 80% sequence identity to the amino acid sequence of SEQ ID NO: 2108.

Embodiment 181. The α4β7 binding protein of embodiment 101, wherein the VH comprises a sequence having at least 80% sequence identity to the amino acid sequence of SEQ ID NO: 2003 and the VL comprises a sequence having at least 80% sequence identity to the amino acid sequence of SEQ ID NO: 2109.

Embodiment 182. The α4β7 binding protein of embodiment 101, wherein the VH comprises a sequence having at least 80% sequence identity to the amino acid sequence of SEQ ID NO: 2004 and the VL comprises a sequence having at least 80% sequence identity to the amino acid sequence of SEQ ID NO: 2110.

Embodiment 183. The α4β7 binding protein of embodiment 101, wherein the VH comprises a sequence having at least 80% sequence identity to the amino acid sequence of SEQ ID NO: 2005 and the VL comprises a sequence having at least 80% sequence identity to the amino acid sequence of SEQ ID NO: 2111.

Embodiment 184. The α4β7 binding protein of embodiment 101, wherein the VH comprises a sequence having at least 80% sequence identity to the amino acid sequence of SEQ ID NO: 2006 and the VL comprises a sequence having at least 80% sequence identity to the amino acid sequence of SEQ ID NO: 2112.

Embodiment 185. The α4β7 binding protein of embodiment 101, wherein the VH comprises a sequence having at least 80% sequence identity to the amino acid sequence of SEQ ID NO: 2007 and the VL comprises a sequence having at least 80% sequence identity to the amino acid sequence of SEQ ID NO: 2113.

Embodiment 186. The α4β7 binding protein of embodiment 101, wherein the VH comprises a sequence having at least 80% sequence identity to the amino acid sequence of SEQ ID NO: 2008 and the VL comprises a sequence having at least 80% sequence identity to the amino acid sequence of SEQ ID NO: 2114.

Embodiment 187. The α4β7 binding protein of embodiment 101, wherein the VH comprises a sequence having at least 80% sequence identity to the amino acid sequence of SEQ ID NO: 2009 and the VL comprises a sequence having at least 80% sequence identity to the amino acid sequence of SEQ ID NO: 2115.

Embodiment 188. The α4β7 binding protein of embodiment 101, wherein the VH comprises a sequence having at least 80% sequence identity to the amino acid sequence of SEQ ID NO: 2010 and the VL comprises a sequence having at least 80% sequence identity to the amino acid sequence of SEQ ID NO: 2116.

Embodiment 189. The α4β7 binding protein of embodiment 101, wherein the VH comprises a sequence having at least 80% sequence identity to the amino acid sequence of SEQ ID NO: 2011 and the VL comprises a sequence having at least 80% sequence identity to the amino acid sequence of SEQ ID NO: 2117.

Embodiment 190. The α4β7 binding protein of embodiment 101, wherein the VH comprises a sequence having at least 80% sequence identity to the amino acid sequence of SEQ ID NO: 2012 and the VL comprises a sequence having at least 80% sequence identity to the amino acid sequence of SEQ ID NO: 2118.

Embodiment 191. The α4β7 binding protein of embodiment 101, wherein the VH comprises a sequence having at least 80% sequence identity to the amino acid sequence of SEQ ID NO: 2013 and the VL comprises a sequence having at least 80% sequence identity to the amino acid sequence of SEQ ID NO: 2119.

Embodiment 192. The α4β7 binding protein of embodiment 101, wherein the VH comprises a sequence having at least 80% sequence identity to the amino acid sequence of SEQ ID NO: 2014 and the VL comprises a sequence having at least 80% sequence identity to the amino acid sequence of SEQ ID NO: 2120.

Embodiment 193. An α4β7 binding protein comprising:
a) a heavy chain variable region (VH) comprising the amino acid sequence according to any one of SEQ ID NOs: 1909, 1910, 1935-1939, 1967; and
b) a light chain variable region (VL) comprising the amino acid sequence according to any one of SEQ ID NOs: 2015, 2016, 2041-2045, 2073.

Embodiment 194. The α4β7 binding protein of embodiment 193, wherein the VH comprises the amino acid sequence according to SEQ ID NO: 1909; and the VL comprises the amino acid sequence according to SEQ ID NO: 2015.

Embodiment 195. The α4β7 binding protein of embodiment 193, wherein the VH comprises the amino acid sequence according to SEQ ID NO: 1910; and the VL comprises the amino acid sequence according to SEQ ID NO: 2016.

Embodiment 196. The α4β7 binding protein of embodiment 193, wherein the VH comprises the amino acid sequence according to SEQ ID NO: 1935; and the VL comprises the amino acid sequence according to SEQ ID NO: 2041.

Embodiment 197. The α4β7 binding protein of embodiment 193, wherein the VH comprises the amino acid sequence according to SEQ ID NO: 1936; and the VL comprises the amino acid sequence according to SEQ ID NO: 2042.

Embodiment 198. The α4β7 binding protein of embodiment 193, wherein the VH comprises the amino acid sequence according to SEQ ID NO: 1937; and the VL comprises the amino acid sequence according to SEQ ID NO: 2043.

Embodiment 199. The α4β7 binding protein of embodiment 193, wherein the VH comprises the amino acid sequence according to SEQ ID NO: 1938; and the VL comprises the amino acid sequence according to SEQ ID NO: 2044.

Embodiment 200. The α4β7 binding protein of embodiment 193, wherein the VH comprises the amino acid sequence according to SEQ ID NO: 1939; and the VL comprises the amino acid sequence according to SEQ ID NO: 2045.

Embodiment 201. The α4β7 binding protein of embodiment 193, wherein the VH comprises the amino acid sequence according to SEQ ID NO: 1967; and the VL comprises the amino acid sequence according to SEQ ID NO: 2073.

Embodiment 202. An α4β7 binding protein comprising:
c) a heavy chain variable region (VH) comprising (i) a CDR1 having an amino acid sequence according to any one of SEQ ID NOs: 1-106, (ii) a CDR2 having an amino acid sequence according to any one of SEQ ID NOs: 107-212, and (iii) a CDR3 having an amino acid sequence according to any one of SEQ ID NOs: 213-318;
d) a light chain variable region (VL) comprising (i) a CDR1 having an amino acid sequence according to any one of SEQ ID NOs: 319-424, (ii) a CDR2 having an amino acid sequence according to any one of SEQ ID NOs: 425-530, and (iii) a CDR3 having an amino acid sequence according to any one of SEQ ID NOs: 531-636; and
e) a modified Fc that comprises amino acid modifications M252Y, S254T, and T256E (YTE) and/or L234A/G237A (LAGA).

Embodiment 203. An α4β7 binding protein comprising:
a) a heavy chain variable region (VH) comprising (i) a CDR1 having an amino acid sequence according to any one of SEQ ID NOs: 1-106, (ii) a CDR2 having an amino acid sequence according to any one of SEQ ID NOs: 107-212, and (iii) a CDR3 having an amino acid sequence according to any one of SEQ ID NOs: 213-318;
b) a light chain variable region (VL) comprising (i) a CDR1 having an amino acid sequence according to any one of SEQ ID NOs: 319-424, (ii) a CDR2 having an amino acid sequence according to any one of SEQ ID NOs: 425-530, and (iii) a CDR3 having an amino acid sequence according to any one of SEQ ID NOs: 531-636; and
c) a modified Fc that extends half-life of the α4β7 binding protein as compared to an α4β7 binding protein that does not comprise the modified Fc.

Embodiment 204. An α4β7 binding protein, wherein the α4β7 binding protein specifically binds to an epitope of α4β7 and comprises a Fc domain comprising amino acid modifications M252Y, S254T, and T256E (YTE) and/or L234A/G237A (LAGA).

Embodiment 205. The α4β7 binding protein of any one of embodiments 202-204, wherein the Fc is an IgG1, IgG2 or IgG4 immunoglobulin Fc domain.

Embodiment 206. The α4β7 binding protein of embodiment 205, wherein the Fc is an IgG1 immunoglobulin domain.

Embodiment 207. The α4β7 binding protein of embodiment 205, wherein the Fc is an IgG2 immunoglobulin domain.

Embodiment 208. The α4β7 binding protein of embodiment 205, wherein the Fc is an IgG4 immunoglobulin domain.

Embodiment 209. A method of treating an inflammatory bowel disease in a patient in need thereof, the method comprising subcutaneously or intravenously administering to the patient an effective amount of an α4β7 binding protein of any one of embodiments 1-208.

Embodiment 210. The method of embodiment 209, wherein the inflammatory bowel disease is Crohn's disease or ulcerative colitis.

Embodiment 211. The method of embodiment 210, wherein the inflammatory bowel disease is ulcerative colitis.

Embodiment 212. The method of embodiment 210, wherein the inflammatory bowel disease is Crohn's disease.

Embodiment 213. The method of any one of embodiments 209-212, wherein administration of the α4β7 binding protein is subcutaneous.

Embodiment 214. The method of any one of embodiments 209-212, wherein administration of the α4β7 binding protein is intravenous.

Embodiment 215. A method of treating an inflammatory disease in a patient in need thereof, the method comprising subcutaneously or intravenously administering to the patient an effective amount of an α4β7 binding protein of any one of embodiments 1-208.

Embodiment 216. The method of embodiment 215, wherein the inflammatory disease is psoriasis.

Embodiment 217. The method of embodiment 215, wherein the inflammatory disease is psoriatic arthritis.

Embodiment 218. The method of embodiment 215, wherein the inflammatory disease is hidradenitis suppurativa.

Embodiment 219. The method of any one of embodiments 215-218, wherein administration of the α4β7 binding protein is subcutaneous.

Embodiment 220. The method of any one of embodiments 215-218, wherein administration of the α4β7 binding protein is intravenous.

Embodiment 221. An isolated nucleic acid encoding the α4β7 binding protein of any one of embodiments 1-208.

Embodiment 222. A recombinant host cell comprising the isolated nucleic acid of embodiment 221.

EXAMPLES

The disclosure now being generally described, will be more readily understood by reference to the following examples, which are included merely for purposes of illustration of certain aspects and embodiments of the present disclosure, and is not intended to limit the disclosure.

Example 1. In Silico Affinity Maturation and Liability Removal of an Anti-α4P7 Integrin Comparator Antibody Residue scanning analysis of an anti-α4β7 integrin comparator antibody, which was humanized from the parental antibody ACT-1, was performed. The three-dimensional structure of ACT-1 in complex with its target antigen, human integrin α4β7 integrin, PDB Code 3V4P, was loaded into the MOE software.

Prior to analysis, the antibody structure was optimized using MOE's automated structural preparation workflow.

Structural issues such as missing atoms or geometric outliers were corrected, and any other non-essential crystallographic molecules were removed to prepare the antibody model for the residue scanning analysis. Hydrogen atoms were added to the model using the Protonate 3D module in MOE, maintaining physiological pH conditions. A restrained minimization was then performed to complete the preparation. The six Complementarity Determining Regions (CDRs) were identified using the MOE Antibody module. Each CDR region was thoroughly examined, and the residues involved were noted for further analysis.

MOE's Residue Scanning tool was employed to perform a systematic scan of all the residues in the CDR regions. The residues were mutated one by one into all other 19 natural amino acids excluding cysteine, and the effects on binding affinity, stability, and other protein properties were predicted using the scoring functions in MOE. Based on the results, we identified key residues in the CDR regions that could be mutated without negatively impacting the binding affinity, stability, or developability of the comparator antibody. Combinations of mutations identified within each CDR were then evaluated in a similar fashion. Results are summarized in Table 4.

TABLE 4

Affinity and Stability of α4β7 Antibodies

| Antibody | ΔAffinity | ΔStability |
|---|---|---|
| Comparator | 0 | 0 |
| Antibody 3 | −1.263 | −0.023 |
| Antibody 4 | −1.157 | −0.041 |
| Antibody 5 | −4.978 | −0.410 |
| Antibody 6 | −5.114 | −0.080 |
| Antibody 7 | −0.264 | −0.474 |
| Antibody 8 | −3.208 | −1.516 |
| Antibody 9 | −8.055 | −2.402 |
| Antibody 10 | −2.632 | −1.704 |
| Antibody 11 | −1.522 | −0.148 |
| Antibody 12 | −6.234 | −1.380 |
| Antibody 13 | −11.591 | −1.619 |
| Antibody 14 | −4.707 | −0.900 |
| Antibody 15 | −1.449 | −0.381 |
| Antibody 16 | −1.862 | −0.111 |
| Antibody 17 | −4.178 | −0.489 |
| Antibody 18 | −0.333 | −0.060 |
| Antibody 19 | −0.867 | −1.198 |
| Antibody 20 | −0.474 | −2.921 |
| Antibody 21 | −0.370 | −0.071 |
| Antibody 22 | −0.165 | −0.323 |
| Antibody 23 | −0.995 | −2.163 |
| Antibody 24 | −1.577 | −0.177 |
| Antibody 25 | −1.973 | −0.173 |
| Antibody 26 | −0.576 | −2.986 |
| Antibody 27 | −0.066 | −0.858 |
| Antibody 28 | −0.277 | −0.405 |
| Antibody 29 | −0.035 | −0.306 |
| Antibody 30 | −0.053 | −0.308 |
| Antibody 31 | −0.112 | −0.537 |
| Antibody 32 | −2.617 | −1.049 |
| Antibody 33 | −0.403 | −1.248 |
| Antibody 34 | −0.157 | −1.092 |
| Antibody 35 | −0.045 | −0.483 |
| Antibody 36 | −0.556 | −1.257 |
| Antibody 37 | −0.297 | −0.856 |
| Antibody 38 | −0.083 | −1.714 |
| Antibody 39 | −0.138 | −1.767 |
| Antibody 40 | −0.753 | −3.059 |
| Antibody 41 | −2.172 | −1.166 |
| Antibody 42 | −4.673 | −0.936 |
| Antibody 43 | −0.724 | −1.043 |
| Antibody 44 | −5.345 | −0.448 |
| Antibody 45 | −6.568 | −0.770 |
| Antibody 46 | −3.807 | −0.373 |
| Antibody 47 | −0.131 | −0.128 |

TABLE 4-continued

Affinity and Stability of α4β7 Antibodies

| Antibody | ΔAffinity | ΔStability |
|---|---|---|
| Antibody 48 | −0.228 | −0.180 |
| Antibody 49 | −3.968 | −0.640 |
| Antibody 50 | −5.855 | −0.407 |
| Antibody 51 | −0.263 | −0.368 |
| Antibody 52 | −0.764 | −2.181 |
| Antibody 53 | −1.711 | −2.767 |
| Antibody 54 | −4.572 | −2.634 |
| Antibody 55 | −1.107 | −2.510 |
| Antibody 56 | −1.401 | −2.407 |
| Antibody 57 | −0.383 | −0.033 |
| Antibody 58 | −3.894 | −1.337 |
| Antibody 59 | −4.109 | −0.556 |
| Antibody 60 | −4.398 | −0.099 |
| Antibody 61 | −4.040 | −1.278 |
| Antibody 62 | −3.698 | −1.531 |
| Antibody 63 | −4.152 | −2.183 |
| Antibody 64 | −5.873 | −0.332 |
| Antibody 65 | −3.976 | −1.208 |
| Antibody 66 | −4.425 | −2.279 |
| Antibody 67 | −5.004 | −2.274 |
| Antibody 68 | −0.500 | −0.102 |
| Antibody 69 | −4.225 | −1.022 |
| Antibody 70 | −9.501 | −2.634 |
| Antibody 71 | −1.102 | −2.164 |
| Antibody 72 | −0.748 | −0.195 |
| Antibody 73 | −6.167 | −0.339 |
| Antibody 74 | −5.074 | −0.440 |
| Antibody 75 | −1.201 | −0.070 |
| Antibody 76 | −1.864 | −0.190 |
| Antibody 77 | −4.980 | −0.660 |
| Antibody 78 | −5.317 | −0.141 |
| Antibody 79 | −4.866 | −0.300 |
| Antibody 80 | −2.600 | −0.143 |
| Antibody 81 | −0.217 | −0.354 |
| Antibody 82 | −0.150 | −0.204 |
| Antibody 83 | −0.297 | −0.217 |
| Antibody 84 | −0.033 | −1.597 |
| Antibody 85 | −0.013 | −3.418 |
| Antibody 86 | −0.006 | −3.183 |
| Antibody 87 | −0.021 | −3.554 |
| Antibody 88 | −0.023 | −2.943 |
| Antibody 89 | −0.021 | −2.415 |
| Antibody 90 | −0.028 | −2.890 |
| Antibody 91 | −0.006 | −1.419 |
| Antibody 92 | −0.148 | −2.796 |
| Antibody 93 | 0.000 | −3.088 |
| Antibody 94 | −0.008 | −1.379 |
| Antibody 95 | −0.138 | −0.800 |
| Antibody 96 | −0.041 | −1.172 |
| Antibody 97 | −0.144 | −3.014 |
| Antibody 98 | −0.221 | −2.542 |
| Antibody 99 | −0.004 | −0.158 |
| Antibody 100 | −0.002 | −0.002 |
| Antibody 101 | −0.005 | −0.664 |
| Antibody 102 | −0.005 | −0.329 |
| Antibody 103 | −0.004 | −0.144 |
| Antibody 104 | −0.003 | −0.060 |
| Antibody 105 | −0.001 | −0.279 |
| Antibody 106 | −0.001 | −0.238 |

ΔAffinity is a measure of predicted change in affinity from the comparator antibody. The absolute value of the number corresponds to the predicted magnitude of improvement. Improvements in affinity are indicated by negative values. Values are unitless predictions. ΔStability is a measure of predicted change in stability from the comparator antibody. The absolute value of the number corresponds to the predicted magnitude of improvement. Improvements in stability are indicated by negative values. Values are unitless predictions.

Example 2. Rehumanization of the Anti-α4β7 Integrin Comparator Antibody

Complementarity-determining region (CDR) grafting approach was used to humanize the parental mouse anti-human α4β7 ACT-1 mouse antibody, the parental monoclonal antibody of the comparator antibody. The parental mouse heavy and light sequences were modeled onto a human antibody framework. A set of human heavy and light chains were selected for humanization. The goal was to design pairs of these heavy and light chains that resulted in improved biophysical properties of the parental antibody while retaining α4β7 integrin binding. These humanized molecules were designed for improved developability profile during scale up in bioprocess.

Example 3. Determination of Antibody Affinity to α4β7 Integrin

A SPR system equipped with a CM5 chip functionalized with an anti-human Fc antibody was used to determine the binding kinetic rates and affinity constants at 25° C. in a running buffer of HBS-P+ with the addition of 1 mM Mn2+, 1 mM Ca2+, and 1 mM Mg2+. Following a stabilization period in running buffer, antibodies previously diluted to 1-1.5 μg/mL were captured on the chip for 30 seconds at a flow rate of 10 μL/min. Subsequently, recombinant human α4β7 integrin was prepared at concentrations of 1.563 nM, 3.125 nM, 6.25 nM, 12.5 nM, 25 nM, 50 nM and 100 nM and injected at a flow rate of 30 μL/min for 180 seconds followed by a dissociation phase with just running buffer at a flow rate of 30 μL/min for 1200 seconds. Samples were injected in a multi-cycle manner over freshly captured mAb, by regenerating the capture surfaces with injection of 10 mM Glycine, pH 1.5. The data was processed and analyzed with SPR analysis software, where sensorgrams were fit to a 1:1 binding model to determine the apparent association (ka) and dissociation rate constants (kd). Their ratio provided the apparent equilibrium dissociation constant or affinity constant (KD=kd/ka). Results are summarized in Table 5.

TABLE 5

| Antibody | Association Constant $(M^{-1}s^{-1})$ | Dissociation Constant $(s^{-1})$ | Apparent $K_D$ (nM) |
|---|---|---|---|
| Comparator | $8.68 \times 10^4$ | $1.22 \times 10^{-4}$ | 1.41 |
| Antibody 1 | $6.85 \times 10^4$ | $4.66 \times 10^{-4}$ | 6.79 |
| Antibody 2 | $5.64 \times 10^4$ | $1.18 \times 10^{-4}$ | 2.10 |

Example 4. Binding to α4β7 Integrin or α4β1 Integrin on Cells

Antibody binding to α4β7 integrin or α4β1 integrin expressed on cells was determined using FACS and two cell lines. The first cell line was RPMI-8866 and is known to only express α4β7 integrin. The second cell line was Ramos and is known to only express α4β1. Briefly, cells were cultured and harvested according to standard vendor instructions. Cells were stained with purified antibodies at concentrations of 0 nM, 0.0064 nM, 0.032 nM, 0.16 nM, 0.8 nM, 4 nM, 20 nM, and 100 nM and incubated at 4° C. for 1 hour. Cells were subsequently stained with an Alexa Fluor 488-conjugated goat anti-human IgG secondary antibody at a 1:1000 dilution. Cells were incubated 4° C. for 1 hour, protected from light. Cells were then washed and the MFI of cells in each well were recorded by FACS using a flow cytometer. Subsequent data were analyzed using GraphPad Prism. EC50 values were determined as the concentration of antibody required to achieve 50% of the maximum plateau MFI. The anti-α4β7 integrin comparator antibody and Antibody 1 and Antibody 2 show specific binding to RPMI-8866 but not Ramos cells. On the other hand, an anti-α4 antibody tested binds to both cell lines. Results are summarized in Table 6 and shown in FIGS. 1 and 2.

TABLE 6

| Antibody | RPMI-8866 Binding $EC_{50}$ (nM) | Ramos Binding $EC_{50}$ (nM) |
|---|---|---|
| Comparator | 0.17 | N.B. |
| Anti-α4 mAb | 0.14 | 0.81 |
| Antibody 1 | 0.20 | N.B. |
| Antibody 2 | 0.27 | N.B. |

N.B.—No binding observed within concentration range tested.

Figure 3:
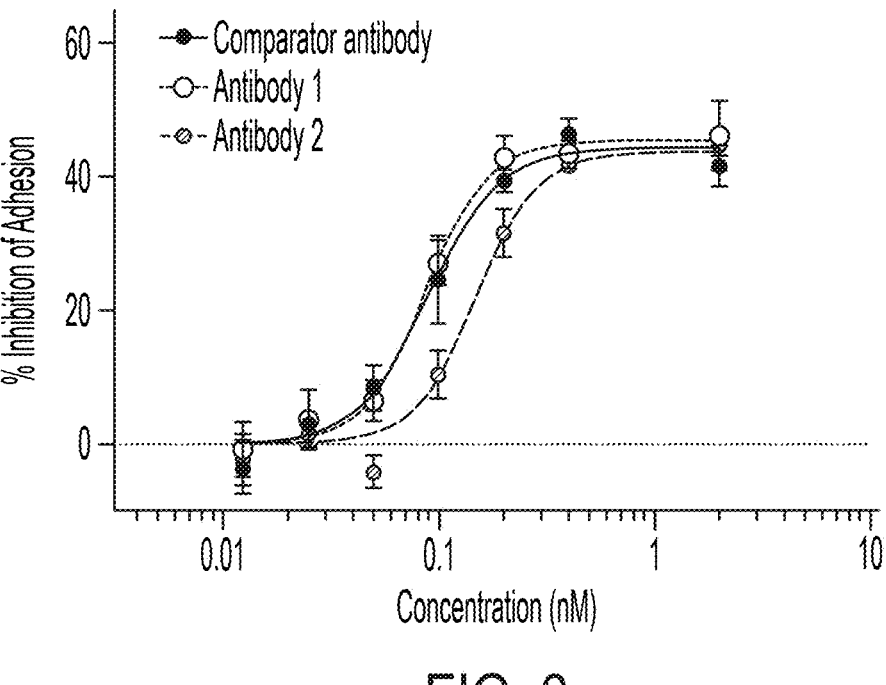
FIG. 3 depicts percent inhibition of adhesion of α4β7 integrin- and α4β1-integrin expressing HuT-78 cells mixed with increasing concentrations of comparator antibody and exemplary antibodies Antibody 1 and Antibody 2 on plates coated with MAdCAM-1. X-axis depicts antibody concentration in nanomolar (nM) and y-axis depicts percent inhibition of adhesion.
Figure 4:
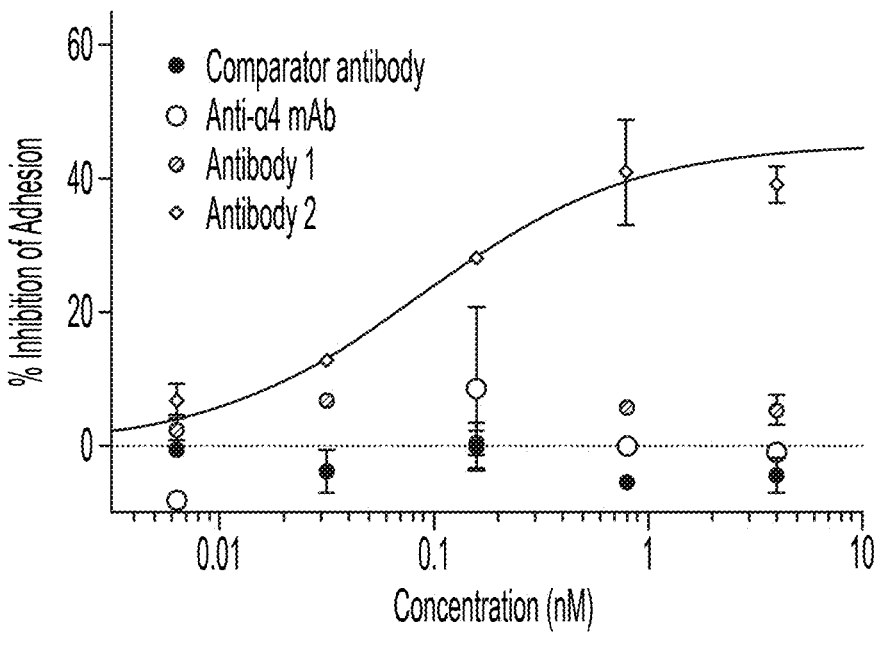
FIG. 4 depicts percent inhibition of adhesion of α4β7 integrin- and α4β1-integrin expressing HuT-78 cells mixed with increasing concentrations of comparator antibody, a control anti-α4 antibody, and exemplary antibodies Antibody 1 and Antibody 2 on plates coated with VCAM-1. X-axis depicts antibody concentration in nanomolar (nM) and y-axis depicts percent inhibition of adhesion.

Example 5. Inhibition of Cellular Adhesion Via MAdCAM-1 and α4β7 Integrin or VCAM-1 and α4ρ1 Integrin Integrins mediate cellular adhesion by binding to distinct cell adhesion molecules. Specifically, α4β7 integrin mediates adhesion through binding of MAdCAM-1 while α4β7 integrin mediates adhesion through binding of VCAM-1. To determine the ability of antibodies to block cellular adhesion mediated through either α4β7 integrin:MAdCAM-1 interaction or α4β1 integrin:VCAM-1, a cellular adhesion assay was conducted using HuT-78 cells, which have been shown to express both α4β7 and α4β1. Briefly, plates were prepared in advance by coating wells with either MAdCAM-1 diluted in PBS to 0.4 μg/mL or VCAM-1 diluted in PBS to 0.5 μg/mL. Plates were incubated at 4° C. overnight. The next day, cells were harvested according to standard vendor instructions. Cells were stained with Calcein AM, using a ratio of 1 μL of 1 mM Calcein AM per 1 mL of $1\times10^6$ cells. Cells were incubated at 37° C. for 30 minutes. Subsequently cells were washed and resuspended in assay media consisting of DMEM, 0.1% BSA, 10 mM HEPES, and 0.5 mM $MnCl_2$ to a density of 800,000 cells/mL. Purified antibodies were mixed with cells at a 1:1 volume ratio, centrifuged gently at 10×g for 1 minute, and incubated at 37° C. for 30 minutes. Antibodies were used at final concentrations of 0 nM, 0.0125 nM, 0.025 nM, 0.05 nM, 0.1 nM, 0.2 nM, 0.4 nM, and 2 nM. Using a plate reader, individual well fluorescence values were read with a 485 nm excitation and 520 nm emission. Wells were then gently washed twice with washing buffer and plates were analyzed again in the same manner. Subsequent data were analyzed using GraphPad Prism. IC50 values were determined as the concentration of antibody required to inhibit 50% of the maximum cell adhesion observed. The comparator antibody and variant antibodies showed specific inhibition of MAdCAM-1 mediated cell adhesion but not VCAM-1 mediated. On the other hand, an anti-α4 antibody tested was able to inhibit cellular adhesion by VCAM-1. Results are summarized in Table 7 and shown in FIGS. 3 and 4.

TABLE 7

| Antibody | MAdCAM-1 Adhesion Inhibition $IC_{50}$ (nM) | VCAM-1 Adhesion Inhibition $IC_{50}$ (nM) |
|---|---|---|
| Comparator | 0.090 | N.I. |
| Anti-α4 mAb | N.T. | 0.87 |
| Antibody 1 | 0.087 | N.I. |
| Antibody 2 | 0.15 | N.I. |

N.T.—Not tested.
N.I.—No inhibition observed within concentration range tested.

EQUIVALENTS

The disclosure may be embodied in other specific forms without departing from the spirit or essential characteristics thereof. The foregoing embodiments are therefore to be considered in all respects illustrative rather than limiting the disclosure described herein. Scope of the disclosure is thus indicated by the appended claims rather than by the foregoing description, and all changes that come within the meaning and range of equivalency of the claims are intended to be embraced therein.

SEQUENCE LISTING (2232 sequences)

SEQ ID NO: 1 - protein, 5 aa, synthetic construct
SYWMH

SEQ ID NO: 2 - protein, 5 aa, synthetic construct
SYWMH

SEQ ID NO: 3 - protein, 5 aa, synthetic construct
IYWMH

SEQ ID NO: 4 - protein, 5 aa, synthetic construct
VYWMH

SEQ ID NO: 5 - protein, 5 aa, synthetic construct
SMWMH

SEQ ID NO: 6 - protein, 5 aa, synthetic construct
SQWMH

SEQ ID NO: 7 - protein, 5 aa, synthetic construct
SYWMH

SEQ ID NO: 8 - protein, 5 aa, synthetic construct
SYWMH

SEQ ID NO: 9 - protein, 5 aa, synthetic construct
SYWMH

SEQ ID NO: 10 - protein, 5 aa, synthetic construct
SYWMH

SEQ ID NO: 11 - protein, 5 aa, synthetic construct
SYWMH

SEQ ID NO: 12 - protein, 5 aa, synthetic construct
SYWMH

SEQ ID NO: 13 - protein, 5 aa, synthetic construct
SYWMH

SEQ ID NO: 14 - protein, 5 aa, synthetic construct
SYWMH

SEQ ID NO: 15 - protein, 5 aa, synthetic construct
SYWMH

SEQ ID NO: 16 - protein, 5 aa, synthetic construct
SYWMH

SEQ ID NO: 17 - protein, 5 aa, synthetic construct
SYWMH

SEQ ID NO: 18 - protein, 5 aa, synthetic construct
SYWMH

SEQ ID NO: 19 - protein, 5 aa, synthetic construct
SYWMH

SEQ ID NO: 20 - protein, 5 aa, synthetic construct
SYWMH

SEQ ID NO: 21 - protein, 5 aa, synthetic construct
SYWMH

SEQ ID NO: 22 - protein, 5 aa, synthetic construct
SYWMH

SEQ ID NO: 23 - protein, 5 aa, synthetic construct
SYWMH

SEQ ID NO: 24 - protein, 5 aa, synthetic construct
SYWMH

SEQ ID NO: 25 - protein, 5 aa, synthetic construct
SYWMH

SEQ ID NO: 26 - protein, 5 aa, synthetic construct
SYWMH

SEQ ID NO: 27 - protein, 5 aa, synthetic construct
SYWMH

SEQ ID NO: 28 - protein, 5 aa, synthetic construct
SYWMH

SEQ ID NO: 29 - protein, 5 aa, synthetic construct
SYWMH

SEQ ID NO: 30 - protein, 5 aa, synthetic construct
SYWMH

SEQ ID NO: 31 - protein, 5 aa, synthetic construct
SYWMH

SEQ ID NO: 32 - protein, 5 aa, synthetic construct
SYWMH

SEQ ID NO: 33 - protein, 5 aa, synthetic construct
SYWMH

SEQ ID NO: 34 - protein, 5 aa, synthetic construct
SYWMH

SEQ ID NO: 35 - protein, 5 aa, synthetic construct
SYWMH

SEQ ID NO: 36 - protein, 5 aa, synthetic construct
SYWMH

SEQ ID NO: 37 - protein, 5 aa, synthetic construct
SYWMH

SEQ ID NO: 38 - protein, 5 aa, synthetic construct
SYWMH

SEQ ID NO: 39 - protein, 5 aa, synthetic construct
SYWMH

SEQ ID NO: 40 - protein, 5 aa, synthetic construct
SYWMH

SEQ ID NO: 41 - protein, 5 aa, synthetic construct
SYWMH

SEQ ID NO: 42 - protein, 5 aa, synthetic construct
SYWMH

SEQ ID NO: 43 - protein, 5 aa, synthetic construct
SYWMH

SEQ ID NO: 44 - protein, 5 aa, synthetic construct
SYWMH

SEQ ID NO: 45 - protein, 5 aa, synthetic construct
SYWMH

SEQ ID NO: 46 - protein, 5 aa, synthetic construct
SYWMH

SEQ ID NO: 47 - protein, 5 aa, synthetic construct
SYWMH

SEQ ID NO: 48 - protein, 5 aa, synthetic construct
SYWMH

SEQ ID NO: 49 - protein, 5 aa, synthetic construct
SYWMH

SEQ ID NO: 50 - protein, 5 aa, synthetic construct
SYWMH

SEQ ID NO: 51 - protein, 5 aa, synthetic construct
SYWMH

SEQ ID NO: 52 - protein, 5 aa, synthetic construct
SYWMH

SEQ ID NO: 53 - protein, 5 aa, synthetic construct
SYWMH

SEQ ID NO: 54 - protein, 5 aa, synthetic construct
SYWMH

SEQ ID NO: 55 - protein, 5 aa, synthetic construct
SYWMH

SEQ ID NO: 56 - protein, 5 aa, synthetic construct
SYWMH

SEQ ID NO: 57 - protein, 5 aa, synthetic construct
SYWMH

SEQ ID NO: 58 - protein, 5 aa, synthetic construct
SYWMH

SEQ ID NO: 59 - protein, 5 aa, synthetic construct
SYWMH

SEQ ID NO: 60 - protein, 5 aa, synthetic construct
SYWMH

SEQ ID NO: 61 - protein, 5 aa, synthetic construct
SYWMH

SEQ ID NO: 62 - protein, 5 aa, synthetic construct
SYWMH

SEQ ID NO: 63 - protein, 5 aa, synthetic construct
SYWMH

SEQ ID NO: 64 - protein, 5 aa, synthetic construct
SYWMH

SEQ ID NO: 65 - protein, 5 aa, synthetic construct
SYWMH

SEQ ID NO: 66 - protein, 5 aa, synthetic construct
SYWMH

SEQ ID NO: 67 - protein, 5 aa, synthetic construct
SYWMH

SEQ ID NO: 68 - protein, 5 aa, synthetic construct
SYWMH

SEQ ID NO: 69 - protein, 5 aa, synthetic construct
SYWMH

SEQ ID NO: 70 - protein, 5 aa, synthetic construct
SYWMH

SEQ ID NO: 71 - protein, 5 aa, synthetic construct
SYWMH

SEQ ID NO: 72 - protein, 5 aa, synthetic construct
SYWMH

SEQ ID NO: 73 - protein, 5 aa, synthetic construct
SYWMH

SEQ ID NO: 74 - protein, 5 aa, synthetic construct
SYWMH

SEQ ID NO: 75 - protein, 5 aa, synthetic construct
SYWMH

SEQ ID NO: 76 - protein, 5 aa, synthetic construct
SYWMH

SEQ ID NO: 77 - protein, 5 aa, synthetic construct
SYWMH

SEQ ID NO: 78 - protein, 5 aa, synthetic construct
SYWMH

SEQ ID NO: 79 - protein, 5 aa, synthetic construct
SYWMH

SEQ ID NO: 80 - protein, 5 aa, synthetic construct
SYWMH

SEQ ID NO: 81 - protein, 5 aa, synthetic construct
SYWMH

SEQ ID NO: 82 - protein, 5 aa, synthetic construct
SYWMH

SEQ ID NO: 83 - protein, 5 aa, synthetic construct
SYWMH

SEQ ID NO: 84 - protein, 5 aa, synthetic construct
SYWMH

SEQ ID NO: 85 - protein, 5 aa, synthetic construct
SYWMH

SEQ ID NO: 86 - protein, 5 aa, synthetic construct
SYWMH

SEQ ID NO: 87 - protein, 5 aa, synthetic construct
SYWMH

SEQ ID NO: 88 - protein, 5 aa, synthetic construct
SYWMH

SEQ ID NO: 89 - protein, 5 aa, synthetic construct
SYWMH

SEQ ID NO: 90 - protein, 5 aa, synthetic construct
SYWMH

SEQ ID NO: 91 - protein, 5 aa, synthetic construct
SYWMH

SEQ ID NO: 92 - protein, 5 aa, synthetic construct
SYWMH

SEQ ID NO: 93 - protein, 5 aa, synthetic construct
SYWMH

SEQ ID NO: 94 - protein, 5 aa, synthetic construct
SYWMH

SEQ ID NO: 95 - protein, 5 aa, synthetic construct
SYWMH

SEQ ID NO: 96 - protein, 5 aa, synthetic construct
SYWMH

SEQ ID NO: 97 - protein, 5 aa, synthetic construct
SYWMH

SEQ ID NO: 98 - protein, 5 aa, synthetic construct
SYWMH

SEQ ID NO: 99 - protein, 5 aa, synthetic construct
SYWMH

SEQ ID NO: 100 - protein, 5 aa, synthetic construct
SYWMH

SEQ ID NO: 101 - protein, 5 aa, synthetic construct
SYWMH

SEQ ID NO: 102 - protein, 5 aa, synthetic construct
SYWMH

SEQ ID NO: 103 - protein, 5 aa, synthetic construct
SYWMH

SEQ ID NO: 104 - protein, 5 aa, synthetic construct
SYWMH

SEQ ID NO: 105 - protein, 5 aa, synthetic construct
SYWMH

SEQ ID NO: 106 - protein, 5 aa, synthetic construct
SYWMH

SEQ ID NO: 107 - protein, 17 aa, synthetic construct
EIDPSESNTNYNQKFKG

SEQ ID NO: 108 - protein, 17 aa, synthetic construct
EIDPSESNTNYNQKFKG

SEQ ID NO: 109 - protein, 17 aa, synthetic construct
EIDPSESNTNYNQKFKG

SEQ ID NO: 110 - protein, 17 aa, synthetic construct
EIDPSESNTNYNQKFKG

SEQ ID NO: 111 - protein, 17 aa, synthetic construct
EIDPSESNTNYNQKFKG

SEQ ID NO: 112 - protein, 17 aa, synthetic construct
EIDPSESNTNYNQKFKG

SEQ ID NO: 113 - protein, 17 aa, synthetic construct
EIIPSESNTNYNQKFKG

SEQ ID NO: 114 - protein, 17 aa, synthetic construct
EIIPLESNTNYNQKFKG

SEQ ID NO: 115 - protein, 17 aa, synthetic construct
EIIPRESNTNYNQKFKG

SEQ ID NO: 116 - protein, 17 aa, synthetic construct
EIIPVESNTNYNQKFKG

SEQ ID NO: 117 - protein, 17 aa, synthetic construct
EIRPSESNTNYNQKFKG

SEQ ID NO: 118 - protein, 17 aa, synthetic construct
EIRPLESNTNYNQKFKG

SEQ ID NO: 119 - protein, 17 aa, synthetic construct
EIRPRESNTNYNQKFKG

SEQ ID NO: 120 - protein, 17 aa, synthetic construct
EIRPVESNTNYNQKFKG

SEQ ID NO: 121 - protein, 17 aa, synthetic construct
EIDPLESNTNYNQKFKG

SEQ ID NO: 122 - protein, 17 aa, synthetic construct
EIDPMESNTNYNQKFKG

SEQ ID NO: 123 - protein, 17 aa, synthetic construct
EIDPRESNTNYNQKFKG

SEQ ID NO: 124 - protein, 17 aa, synthetic construct
EIDPVESNTNYNQKFKG

SEQ ID NO: 125 - protein, 17 aa, synthetic construct
EIDPSESNTNYNQKFKG

SEQ ID NO: 126 - protein, 17 aa, synthetic construct
EIDPSESNTNYNQKFKG

SEQ ID NO: 127 - protein, 17 aa, synthetic construct
EIDPSESNTNYNQKFKG

SEQ ID NO: 128 - protein, 17 aa, synthetic construct
EIDPSESNTNYNQKFKG

SEQ ID NO: 129 - protein, 17 aa, synthetic construct
EIDPSESNTNYNQKFKG

SEQ ID NO: 130 - protein, 17 aa, synthetic construct
EIDPSESNTNYNQKFKG

SEQ ID NO: 131 - protein, 17 aa, synthetic construct
EIDPSESNTNYNQKFKG

SEQ ID NO: 132 - protein, 17 aa, synthetic construct
EIDPSESNTNYNQKFKG

SEQ ID NO: 133 - protein, 17 aa, synthetic construct
EIDPSESNTNYNQKFKG

SEQ ID NO: 134 - protein, 17 aa, synthetic construct
EIDPSESNTNYNQKFKG

SEQ ID NO: 135 - protein, 17 aa, synthetic construct
EIDPSESNTNYNQKFKG

SEQ ID NO: 136 - protein, 17 aa, synthetic construct
EIDPSESNTNYNQKFKG

SEQ ID NO: 137 - protein, 17 aa, synthetic construct
EIDPSESNTNYNQKFKG

SEQ ID NO: 138 - protein, 17 aa, synthetic construct
EIDPSESNTNYNQKFKG

SEQ ID NO: 139 - protein, 17 aa, synthetic construct
EIDPSESNTNYNQKFKG

SEQ ID NO: 140 - protein, 17 aa, synthetic construct
EIDPSESNTNYNQKFKG

SEQ ID NO: 141 - protein, 17 aa, synthetic construct
EIDPSESNTNYNQKFKG

SEQ ID NO: 142 - protein, 17 aa, synthetic construct
EIDPSESNTNYNQKFKG

SEQ ID NO: 143 - protein, 17 aa, synthetic construct
EIDPSESNTNYNQKFKG

SEQ ID NO: 144 - protein, 17 aa, synthetic construct
EIDPSESNTNYNQKFKG

SEQ ID NO: 145 - protein, 17 aa, synthetic construct
EIDPSESNTNYNQKFKG

SEQ ID NO: 146 - protein, 17 aa, synthetic construct
EIDPSESNTNYNQKFKG

SEQ ID NO: 147 - protein, 17 aa, synthetic construct
EIDPSESNTNYNQKFKG

SEQ ID NO: 148 - protein, 17 aa, synthetic construct
EIDPSESNTNYNQKFKG

SEQ ID NO: 149 - protein, 17 aa, synthetic construct
EIDPSESNTNYNQKFKG

SEQ ID NO: 150 - protein, 17 aa, synthetic construct
EIDPSESNTNYNQKFKG

SEQ ID NO: 151 - protein, 17 aa, synthetic construct
EIDPSESNTNYNQKFKG

SEQ ID NO: 152 - protein, 17 aa, synthetic construct
EIDPSESNTNYNQKFKG

SEQ ID NO: 153 - protein, 17 aa, synthetic construct
EIDPSESNTNYNQKFKG

SEQ ID NO: 154 - protein, 17 aa, synthetic construct
EIDPSESNTNYNQKFKG

SEQ ID NO: 155 - protein, 17 aa, synthetic construct
EIDPSESNTNYNQKFKG

SEQ ID NO: 156 - protein, 17 aa, synthetic construct
EIDPSESNTNYNQKFKG

SEQ ID NO: 157 - protein, 17 aa, synthetic construct
EIDPSESNTNYNQKFKG

SEQ ID NO: 158 - protein, 17 aa, synthetic construct
EIDPSESNTNYNQKFKG

SEQ ID NO: 159 - protein, 17 aa, synthetic construct
EIDPSESNTNYNQKFKG

SEQ ID NO: 160 - protein, 17 aa, synthetic construct
EIDPSESNTNYNQKFKG

SEQ ID NO: 161 - protein, 17 aa, synthetic construct
EIDPSESNTNYNQKFKG

SEQ ID NO: 162 - protein, 17 aa, synthetic construct
EIDPSESNTNYNQKFKG

SEQ ID NO: 163 - protein, 17 aa, synthetic construct
EIDPSESNTNYNQKFKG

SEQ ID NO: 164 - protein, 17 aa, synthetic construct
EIDPSESNTNYNQKFKG

SEQ ID NO: 165 - protein, 17 aa, synthetic construct
EIDPSESNTNYNQKFKG

SEQ ID NO: 166 - protein, 17 aa, synthetic construct
EIDPSESNTNYNQKFKG

SEQ ID NO: 167 - protein, 17 aa, synthetic construct
EIDPSESNTNYNQKFKG

SEQ ID NO: 168 - protein, 17 aa, synthetic construct
EIDPSESNTNYNQKFKG

SEQ ID NO: 169 - protein, 17 aa, synthetic construct
EIDPSESNTNYNQKFKG

SEQ ID NO: 170 - protein, 17 aa, synthetic construct
EIDPSESNTNYNQKFKG

SEQ ID NO: 171 - protein, 17 aa, synthetic construct
EIDPSESNTNYNQKFKG

SEQ ID NO: 172 - protein, 17 aa, synthetic construct
EIDPSESNTNYNQKFKG

SEQ ID NO: 173 - protein, 17 aa, synthetic construct
EIDPSESNTNYNQKFKG

SEQ ID NO: 174 - protein, 17 aa, synthetic construct
EIDPSESNTNYNQKFKG

SEQ ID NO: 175 - protein, 17 aa, synthetic construct
EIDPSESNTNYNQKFKG

SEQ ID NO: 176 - protein, 17 aa, synthetic construct
EIDPSESNTNYNQKFKG

SEQ ID NO: 177 - protein, 17 aa, synthetic construct
EIDPSESNTNYNQKFKG

SEQ ID NO: 178 - protein, 17 aa, synthetic construct
EIDPSESNTNYNQKFKG

SEQ ID NO: 179 - protein, 17 aa, synthetic construct
EIDPSESNTNYNQKFKG

SEQ ID NO: 180 - protein, 17 aa, synthetic construct
EIDPSESNTNYNQKFKG

SEQ ID NO: 181 - protein, 17 aa, synthetic construct
EIDPSESNTNYNQKFKG

SEQ ID NO: 182 - protein, 17 aa, synthetic construct
EIDPSESNTNYNQKFKG

SEQ ID NO: 183 - protein, 17 aa, synthetic construct
EIDPSESNTNYNQKFKG

SEQ ID NO: 184 - protein, 17 aa, synthetic construct
EIDPSESNTNYNQKFKG

SEQ ID NO: 185 - protein, 17 aa, synthetic construct
EIDPSESNTNYNQKFKG

SEQ ID NO: 186 - protein, 17 aa, synthetic construct
EIDPSESNTNYNQKFKG

SEQ ID NO: 187 - protein, 17 aa, synthetic construct
EIDPSESNTNYNQKFKG

SEQ ID NO: 188 - protein, 17 aa, synthetic construct
EIDPSESNTNYNQKFKG

SEQ ID NO: 189 - protein, 17 aa, synthetic construct
EIDPSESNTNYNQKFKG

SEQ ID NO: 190 - protein, 17 aa, synthetic construct
EIDPSESNTNYNQKFKG

SEQ ID NO: 191 - protein, 17 aa, synthetic construct
EIDPSESNTNYNQKFKG

SEQ ID NO: 192 - protein, 17 aa, synthetic construct
EIDPSESNTNYNQKFKG

SEQ ID NO: 193 - protein, 17 aa, synthetic construct
EIDPSESNTNYNQKFKG

SEQ ID NO: 194 - protein, 17 aa, synthetic construct
EIDPSESNTNYNQKFKG

SEQ ID NO: 195 - protein, 17 aa, synthetic construct
EIDPSESNTNYNQKFKG

SEQ ID NO: 196 - protein, 17 aa, synthetic construct
EIDPSESNTNYNQKFKG

SEQ ID NO: 197 - protein, 17 aa, synthetic construct
EIDPSESNTNYNQKFKG

SEQ ID NO: 198 - protein, 17 aa, synthetic construct
EIDPSESNTNYNQKFKG

SEQ ID NO: 199 - protein, 17 aa, synthetic construct
EIDPSESNTNYNQKFKG

SEQ ID NO: 200 - protein, 17 aa, synthetic construct
EIDPSESNTNYNQKFKG

SEQ ID NO: 201 - protein, 17 aa, synthetic construct
EIDPSESNTNYNQKFKG

SEQ ID NO: 202 - protein, 17 aa, synthetic construct
EIDPSESNTNYNQKFKG

SEQ ID NO: 203 - protein, 17 aa, synthetic construct
EIDPSESNTNYNQKFKG

SEQ ID NO: 204 - protein, 17 aa, synthetic construct
EIDPSESNTNYNQKFKG

SEQ ID NO: 205 - protein, 17 aa, synthetic construct
EIDPSESNTNYNQKFKG

SEQ ID NO: 206 - protein, 17 aa, synthetic construct
EIDPSESNTNYNQKFKG

SEQ ID NO: 207 - protein, 17 aa, synthetic construct
EIDPSESNTNYNQKFKG

SEQ ID NO: 208 - protein, 17 aa, synthetic construct
EIDPSESNTNYNQKFKG

SEQ ID NO: 209 - protein, 17 aa, synthetic construct
EIDPSESNTNYNQKFKG

SEQ ID NO: 210 - protein, 17 aa, synthetic construct
EIDPSESNTNYNQKFKG

SEQ ID NO: 211 - protein, 17 aa, synthetic construct
EIDPSESNTNYNQKFKG

SEQ ID NO: 212 - protein, 17 aa, synthetic construct
EIDPSESNTNYNQKFKG

SEQ ID NO: 213 - protein, 12 aa, synthetic construct
GGYDGWDYAIDY

SEQ ID NO: 214 - protein, 12 aa, synthetic construct
GGYDGWDYAIDY

SEQ ID NO: 215 - protein, 12 aa, synthetic construct
GGYDGWDYAIDY

SEQ ID NO: 216 - protein, 12 aa, synthetic construct
GGYDGWDYAIDY

SEQ ID NO: 217 - protein, 12 aa, synthetic construct
GGYDGWDYAIDY

SEQ ID NO: 218 - protein, 12 aa, synthetic construct
GGYDGWDYAIDY

SEQ ID NO: 219 - protein, 12 aa, synthetic construct
GGYDGWDYAIDY

SEQ ID NO: 220 - protein, 12 aa, synthetic construct
GGYDGWDYAIDY

SEQ ID NO: 221 - protein, 12 aa, synthetic construct
GGYDGWDYAIDY

SEQ ID NO: 222 - protein, 12 aa, synthetic construct
GGYDGWDYAIDY

SEQ ID NO: 223 - protein, 12 aa, synthetic construct
GGYDGWDYAIDY

SEQ ID NO: 224 - protein, 12 aa, synthetic construct
GGYDGWDYAIDY

SEQ ID NO: 225 - protein, 12 aa, synthetic construct
GGYDGWDYAIDY

SEQ ID NO: 226 - protein, 12 aa, synthetic construct
GGYDGWDYAIDY

SEQ ID NO: 227 - protein, 12 aa, synthetic construct
GGYDGWDYAIDY

SEQ ID NO: 228 - protein, 12 aa, synthetic construct
GGYDGWDYAIDY

SEQ ID NO: 229 - protein, 12 aa, synthetic construct
GGYDGWDYAIDY

SEQ ID NO: 230 - protein, 12 aa, synthetic construct
GGYDGWDYAIDY

SEQ ID NO: 231 - protein, 12 aa, synthetic construct
GGYDGWDYFIDY

SEQ ID NO: 232 - protein, 12 aa, synthetic construct
GGYDGWDYFIYY

SEQ ID NO: 233 - protein, 12 aa, synthetic construct
GGYDGWDYLIDY

SEQ ID NO: 234 - protein, 12 aa, synthetic construct
GGYDGWDYVIDY

SEQ ID NO: 235 - protein, 12 aa, synthetic construct
GGYDGWDYVIYY

SEQ ID NO: 236 - protein, 12 aa, synthetic construct
GGYDGWDYWIDY

SEQ ID NO: 237 - protein, 12 aa, synthetic construct
GGYDGWDYYIDY

SEQ ID NO: 238 - protein, 12 aa, synthetic construct
GGYDGWDYYIYY

SEQ ID NO: 239 - protein, 12 aa, synthetic construct
GGYDGWDYAIDY

SEQ ID NO: 240 - protein, 12 aa, synthetic construct
GGYDGWDYAIDY

SEQ ID NO: 241 - protein, 12 aa, synthetic construct
GGYDGWDYAIDY

SEQ ID NO: 242 - protein, 12 aa, synthetic construct
GGYDGWDYAIDY

SEQ ID NO: 243 - protein, 12 aa, synthetic construct
GGYDGWDYAIDY

SEQ ID NO: 244 - protein, 12 aa, synthetic construct
GGYWGWDYAIDY

SEQ ID NO: 245 - protein, 12 aa, synthetic construct
GGYYGWDYAIDY

SEQ ID NO: 246 - protein, 12 aa, synthetic construct
GGYDGWDYAIFY

SEQ ID NO: 247 - protein, 12 aa, synthetic construct
GGYDGWDYAIMY

SEQ ID NO: 248 - protein, 12 aa, synthetic construct
GGYDGWDYAIWY

SEQ ID NO: 249 - protein, 12 aa, synthetic construct
GGYDGWDYAIYY

SEQ ID NO: 250 - protein, 12 aa, synthetic construct
GFYDGWDYAIDY

SEQ ID NO: 251 - protein, 12 aa, synthetic construct
GFYDGWDYLIDY

SEQ ID NO: 252 - protein, 12 aa, synthetic construct
GFYDGWDYAIYY

SEQ ID NO: 253 - protein, 12 aa, synthetic construct
GMYDGWDYAIDY

SEQ ID NO: 254 - protein, 12 aa, synthetic construct
GRYDGWDYAIDY

SEQ ID NO: 255 - protein, 12 aa, synthetic construct
GVYDGWDYAIDY

SEQ ID NO: 256 - protein, 12 aa, synthetic construct
GGYDIWDYAIDY

SEQ ID NO: 257 - protein, 12 aa, synthetic construct
GGYDLWDYAIDY

SEQ ID NO: 258 - protein, 12 aa, synthetic construct
GGYDVWDYAIDY

SEQ ID NO: 259 - protein, 12 aa, synthetic construct
FGYDGWDYAIDY

SEQ ID NO: 260 - protein, 12 aa, synthetic construct
YGYDGWDYAIDY

SEQ ID NO: 261 - protein, 12 aa, synthetic construct
GGYDGWDYAIDY

SEQ ID NO: 262 - protein, 12 aa, synthetic construct
GGYDGWDYAIDY

SEQ ID NO: 263 - protein, 12 aa, synthetic construct
GGYDGWDYAIDY

SEQ ID NO: 264 - protein, 12 aa, synthetic construct
GGYDGWDYAIDY

SEQ ID NO: 265 - protein, 12 aa, synthetic construct
GGYDGWDYAIDY

SEQ ID NO: 266 - protein, 12 aa, synthetic construct
GGYDGWDYAIDY

SEQ ID NO: 267 - protein, 12 aa, synthetic construct
GGYDGWDYAIDY

SEQ ID NO: 268 - protein, 12 aa, synthetic construct
GGYDGWDYAIDY

SEQ ID NO: 269 - protein, 12 aa, synthetic construct
GGYDGWDYAIDY

SEQ ID NO: 270 - protein, 12 aa, synthetic construct
GGYDGWDYAIDY

SEQ ID NO: 271 - protein, 12 aa, synthetic construct
GGYDGWDYAIDY

SEQ ID NO: 272 - protein, 12 aa, synthetic construct
GGYDGWDYAIDY

SEQ ID NO: 273 - protein, 12 aa, synthetic construct
GGYDGWDYAIDY

SEQ ID NO: 274 - protein, 12 aa, synthetic construct
GGYDGWDYAIDY

SEQ ID NO: 275 - protein, 12 aa, synthetic construct
GGYDGWDYAIDY

SEQ ID NO: 276 - protein, 12 aa, synthetic construct
GGYDGWDYAIDY

SEQ ID NO: 277 - protein, 12 aa, synthetic construct
GGYDGWDYAIDY

SEQ ID NO: 278 - protein, 12 aa, synthetic construct
GGYDGWDYAIDY

SEQ ID NO: 279 - protein, 12 aa, synthetic construct
GGYDGWDYAIDY

SEQ ID NO: 280 - protein, 12 aa, synthetic construct
GGYDGWDYAIDY

SEQ ID NO: 281 - protein, 12 aa, synthetic construct
GGYDGWDYAIDY

SEQ ID NO: 282 - protein, 12 aa, synthetic construct
GGYDGWDYAIDY

SEQ ID NO: 283 - protein, 12 aa, synthetic construct
GGYDGWDYAIDY

SEQ ID NO: 284 - protein, 12 aa, synthetic construct
GGYDGWDYAIDY

SEQ ID NO: 285 - protein, 12 aa, synthetic construct
GGYDGWDYAIDY

SEQ ID NO: 286 - protein, 12 aa, synthetic construct
GGYDGWDYAIDY

SEQ ID NO: 287 - protein, 12 aa, synthetic construct
GGYDGWDYAIDY

SEQ ID NO: 288 - protein, 12 aa, synthetic construct
GGYDGWDYAIDY

SEQ ID NO: 289 - protein, 12 aa, synthetic construct
GGYDGWDYAIDY

SEQ ID NO: 290 - protein, 12 aa, synthetic construct
GGYDGWDYAIDY

SEQ ID NO: 291 - protein, 12 aa, synthetic construct
GGYDGWDYAIDY

SEQ ID NO: 292 - protein, 12 aa, synthetic construct
GGYDGWDYAIDY

SEQ ID NO: 293 - protein, 12 aa, synthetic construct
GGYDGWDYAIDY

SEQ ID NO: 294 - protein, 12 aa, synthetic construct
GGYDGWDYAIDY

SEQ ID NO: 295 - protein, 12 aa, synthetic construct
GGYDGWDYAIDY

SEQ ID NO: 296 - protein, 12 aa, synthetic construct
GGYDGWDYAIDY

SEQ ID NO: 297 - protein, 12 aa, synthetic construct
GGYDGWDYAIDY

SEQ ID NO: 298 - protein, 12 aa, synthetic construct
GGYDGWDYAIDY

SEQ ID NO: 299 - protein, 12 aa, synthetic construct
GGYDGWDYAIDY

SEQ ID NO: 300 - protein, 12 aa, synthetic construct
GGYDGWDYAIDY

SEQ ID NO: 301 - protein, 12 aa, synthetic construct
GGYDGWDYAIDY

SEQ ID NO: 302 - protein, 12 aa, synthetic construct
GGYDGWDYAIDY

SEQ ID NO: 303 - protein, 12 aa, synthetic construct
GGYDGWDYAIDY

SEQ ID NO: 304 - protein, 12 aa, synthetic construct
GGYDGWDYAIDY

SEQ ID NO: 305 - protein, 12 aa, synthetic construct
GGYDGWDYAIDY

SEQ ID NO: 306 - protein, 12 aa, synthetic construct
GGYDGWDYAIDY

SEQ ID NO: 307 - protein, 12 aa, synthetic construct
GGYDGWDYAIDY

SEQ ID NO: 308 - protein, 12 aa, synthetic construct
GGYDGWDYAIDY

SEQ ID NO: 309 - protein, 12 aa, synthetic construct
GGYDGWDYAIDY

SEQ ID NO: 310 - protein, 12 aa, synthetic construct
GGYDGWDYAIDY

SEQ ID NO: 311 - protein, 12 aa, synthetic construct
GGYDGWDYAIDY

SEQ ID NO: 312 - protein, 12 aa, synthetic construct
GGYDGWDYAIDY

SEQ ID NO: 313 - protein, 12 aa, synthetic construct
GGYDGWDYAIDY

SEQ ID NO: 314 - protein, 12 aa, synthetic construct
GGYDGWDYAIDY

SEQ ID NO: 315 - protein, 12 aa, synthetic construct
GGYDGWDYAIDY

SEQ ID NO: 316 - protein, 12 aa, synthetic construct
GGYDGWDYAIDY

SEQ ID NO: 317 - protein, 12 aa, synthetic construct
GGYDGWDYAIDY

SEQ ID NO: 318 - protein, 12 aa, synthetic construct
GGYDGWDYAIDY

SEQ ID NO: 319 - protein, 16 aa, synthetic construct
RSSQSLAKSYGNTYLS

SEQ ID NO: 320 - protein, 16 aa, synthetic construct
RSSQSLAKSYGNTYLS

SEQ ID NO: 321 - protein, 16 aa, synthetic construct
RSSQSLAKSYGNTYLS

SEQ ID NO: 322 - protein, 16 aa, synthetic construct
RSSQSLAKSYGNTYLS

SEQ ID NO: 323 - protein, 16 aa, synthetic construct
RSSQSLAKSYGNTYLS

SEQ ID NO: 324 - protein, 16 aa, synthetic construct
RSSQSLAKSYGNTYLS

SEQ ID NO: 325 - protein, 16 aa, synthetic construct
RSSQSLAKSYGNTYLS

SEQ ID NO: 326 - protein, 16 aa, synthetic construct
RSSQSLAKSYGNTYLS

SEQ ID NO: 327 - protein, 16 aa, synthetic construct
RSSQSLAKSYGNTYLS

SEQ ID NO: 328 - protein, 16 aa, synthetic construct
RSSQSLAKSYGNTYLS

SEQ ID NO: 329 - protein, 16 aa, synthetic construct
RSSQSLAKSYGNTYLS

SEQ ID NO: 330 - protein, 16 aa, synthetic construct
RSSQSLAKSYGNTYLS

SEQ ID NO: 331 - protein, 16 aa, synthetic construct
RSSQSLAKSYGNTYLS

SEQ ID NO: 332 - protein, 16 aa, synthetic construct
RSSQSLAKSYGNTYLS

SEQ ID NO: 333 - protein, 16 aa, synthetic construct
RSSQSLAKSYGNTYLS

SEQ ID NO: 334 - protein, 16 aa, synthetic construct
RSSQSLAKSYGNTYLS

SEQ ID NO: 335 - protein, 16 aa, synthetic construct
RSSQSLAKSYGNTYLS

SEQ ID NO: 336 - protein, 16 aa, synthetic construct
RSSQSLAKSYGNTYLS

SEQ ID NO: 337 - protein, 16 aa, synthetic construct
RSSQSLAKSYGNTYLS

SEQ ID NO: 338 - protein, 16 aa, synthetic construct
RSSQSLAKSYGNTYLS

SEQ ID NO: 339 - protein, 16 aa, synthetic construct
RSSQSLAKSYGNTYLS

SEQ ID NO: 340 - protein, 16 aa, synthetic construct
RSSQSLAKSYGNTYLS

SEQ ID NO: 341 - protein, 16 aa, synthetic construct
RSSQSLAKSYGNTYLS

SEQ ID NO: 342 - protein, 16 aa, synthetic construct
RSSQSLAKSYGNTYLS

SEQ ID NO: 343 - protein, 16 aa, synthetic construct
RSSQSLAKSYGNTYLS

SEQ ID NO: 344 - protein, 16 aa, synthetic construct
RSSQSLAKSYGNTYLS

SEQ ID NO: 345 - protein, 16 aa, synthetic construct
RSSQSLAKSYGNTYLS

SEQ ID NO: 346 - protein, 16 aa, synthetic construct
RSSQSLAKSYGNTYLS

SEQ ID NO: 347 - protein, 16 aa, synthetic construct
RSSQSLAKSYGNTYLS

SEQ ID NO: 348 - protein, 16 aa, synthetic construct
RSSQSLAKSYGNTYLS

SEQ ID NO: 349 - protein, 16 aa, synthetic construct
RSSQSLAKSYGNTYLS

SEQ ID NO: 350 - protein, 16 aa, synthetic construct
RSSQSLAKSYGNTYLS

SEQ ID NO: 351 - protein, 16 aa, synthetic construct
RSSQSLAKSYGNTYLS

SEQ ID NO: 352 - protein, 16 aa, synthetic construct
RSSQSLAKSYGNTYLS

SEQ ID NO: 353 - protein, 16 aa, synthetic construct
RSSQSLAKSYGNTYLS

SEQ ID NO: 354 - protein, 16 aa, synthetic construct
RSSQSLAKSYGNTYLS

SEQ ID NO: 355 - protein, 16 aa, synthetic construct
RSSQSLAKSYGNTYLS

SEQ ID NO: 356 - protein, 16 aa, synthetic construct
RSSQSLAKSYGNTYLS

SEQ ID NO: 357 - protein, 16 aa, synthetic construct
RSSQSLAKSYGNTYLS

SEQ ID NO: 358 - protein, 16 aa, synthetic construct
RSSQSLAKSYGNTYLS

SEQ ID NO: 359 - protein, 16 aa, synthetic construct
RSSQSLAKSYGNTYLS

SEQ ID NO: 360 - protein, 16 aa, synthetic construct
RSSQSLAKSYGNTYLS

SEQ ID NO: 361 - protein, 16 aa, synthetic construct
RSSQSLAKSYGNTYLS

SEQ ID NO: 362 - protein, 16 aa, synthetic construct
RSSQSLAKSYGNTYLS

SEQ ID NO: 363 - protein, 16 aa, synthetic construct
RSSQSLAKSYGNTYLS

SEQ ID NO: 364 - protein, 16 aa, synthetic construct
RSSQSLAKSYGNTYLS

SEQ ID NO: 365 - protein, 16 aa, synthetic construct
RSSQSLAKSYGNTYLS

SEQ ID NO: 366 - protein, 16 aa, synthetic construct
RSSQSLAKSYGNTYLS

SEQ ID NO: 367 - protein, 16 aa, synthetic construct
RSSQSLAASYGNTYLS

SEQ ID NO: 368 - protein, 16 aa, synthetic construct
RSSQSLADSYGNTYLS

SEQ ID NO: 369 - protein, 16 aa, synthetic construct
RSSQSLAISYGNTYLS

SEQ ID NO: 370 - protein, 16 aa, synthetic construct
RSSQSLAIFYGNTYLS

SEQ ID NO: 371 - protein, 16 aa, synthetic construct
RSSQSLAIFYGITYLS

SEQ ID NO: 372 - protein, 16 aa, synthetic construct
RSSQSLAIFYGLTYLS

SEQ ID NO: 373 - protein, 16 aa, synthetic construct
RSSQSLAILYGITYLS

SEQ ID NO: 374 - protein, 16 aa, synthetic construct
RSSQSLAILYGLTYLS

SEQ ID NO: 375 - protein, 16 aa, synthetic construct
RSSQSLALSYGNTYLS

SEQ ID NO: 376 - protein, 16 aa, synthetic construct
RSSQSLAMSYGNTYLS

SEQ ID NO: 377 - protein, 16 aa, synthetic construct
RSSQSLANSYGNTYLS

SEQ ID NO: 378 - protein, 16 aa, synthetic construct
RSSQSLAPSYGNTYLS

SEQ ID NO: 379 - protein, 16 aa, synthetic construct
RSSQSLAQSYGNTYLS

SEQ ID NO: 380 - protein, 16 aa, synthetic construct
RSSQSLARSYGNTYLS

SEQ ID NO: 381 - protein, 16 aa, synthetic construct
RSSQSLARFYGLTYLS

SEQ ID NO: 382 - protein, 16 aa, synthetic construct
RSSQSLASSYGNTYLS

SEQ ID NO: 383 - protein, 16 aa, synthetic construct
RSSQSLATSYGNTYLS

SEQ ID NO: 384 - protein, 16 aa, synthetic construct
RSSQSLATYYGITYLS

SEQ ID NO: 385 - protein, 16 aa, synthetic construct
RSSQSLATYYGLTYLS

SEQ ID NO: 386 - protein, 16 aa, synthetic construct
RSSQSLAVSYGNTYLS

SEQ ID NO: 387 - protein, 16 aa, synthetic construct
RSSQSLAYSYGNTYLS

SEQ ID NO: 388 - protein, 16 aa, synthetic construct
RSSQSLAYFYGITYLS

SEQ ID NO: 389 - protein, 16 aa, synthetic construct
RSSQSLAYLYGITYLS

SEQ ID NO: 390 - protein, 16 aa, synthetic construct
RSSQSLAKSYGITYLS

SEQ ID NO: 391 - protein, 16 aa, synthetic construct
RSSQSLAKSYGLTYLS

SEQ ID NO: 392 - protein, 16 aa, synthetic construct
RSSQSLAKFYGNTYLS

SEQ ID NO: 393 - protein, 16 aa, synthetic construct
RSSQSLAKIYGNTYLS

SEQ ID NO: 394 - protein, 16 aa, synthetic construct
RSSQSLAKLYGNTYLS

SEQ ID NO: 395 - protein, 16 aa, synthetic construct
RSSQSLAKMYGNTYLS

SEQ ID NO: 396 - protein, 16 aa, synthetic construct
RSSQSLAKQYGNTYLS

SEQ ID NO: 397 - protein, 16 aa, synthetic construct
RSSQSLAKYYGNTYLS

SEQ ID NO: 398 - protein, 16 aa, synthetic construct
RSSQSLAKSHGNTYLS

SEQ ID NO: 399 - protein, 16 aa, synthetic construct
RSSQSLAKSYGNTYLS

SEQ ID NO: 400 - protein, 16 aa, synthetic construct
RSSQSLAKSYGNTYLS

SEQ ID NO: 401 - protein, 16 aa, synthetic construct
RSSQSLAKSYGNTYLS

SEQ ID NO: 402 - protein, 16 aa, synthetic construct
RSSQSLAKSYGNTYLS

SEQ ID NO: 403 - protein, 16 aa, synthetic construct
RSSQSLAKSYGNTYLS

SEQ ID NO: 404 - protein, 16 aa, synthetic construct
RSSQSLAKSYGNTYLS

SEQ ID NO: 405 - protein, 16 aa, synthetic construct
RSSQSLAKSYGNTYLS

SEQ ID NO: 406 - protein, 16 aa, synthetic construct
RSSQSLAKSYGNTYLS

SEQ ID NO: 407 - protein, 16 aa, synthetic construct
RSSQSLAKSYGNTYLS

SEQ ID NO: 408 - protein, 16 aa, synthetic construct
RSSQSLAKSYGNTYLS

SEQ ID NO: 409 - protein, 16 aa, synthetic construct
RSSQSLAKSYGNTYLS

SEQ ID NO: 410 - protein, 16 aa, synthetic construct
RSSQSLAKSYGNTYLS

SEQ ID NO: 411 - protein, 16 aa, synthetic construct
RSSQSLAKSYGNTYLS

SEQ ID NO: 412 - protein, 16 aa, synthetic construct
RSSQSLAKSYGNTYLS

SEQ ID NO: 413 - protein, 16 aa, synthetic construct
RSSQSLAKSYGNTYLS

SEQ ID NO: 414 - protein, 16 aa, synthetic construct
RSSQSLAKSYGNTYLS

SEQ ID NO: 415 - protein, 16 aa, synthetic construct
RSSQSLAKSYGNTYLS

SEQ ID NO: 416 - protein, 16 aa, synthetic construct
RSSQSLAKSYGNTYLS

SEQ ID NO: 417 - protein, 16 aa, synthetic construct
RSSQSLAKSYGNTYLS

SEQ ID NO: 418 - protein, 16 aa, synthetic construct
RSSQSLAKSYGNTYLS

SEQ ID NO: 419 - protein, 16 aa, synthetic construct
RSSQSLAKSYGNTYLS

SEQ ID NO: 420 - protein, 16 aa, synthetic construct
RSSQSLAKSYGNTYLS

SEQ ID NO: 421 - protein, 16 aa, synthetic construct
RSSQSLAKSYGNTYLS

SEQ ID NO: 422 - protein, 16 aa, synthetic construct
RSSQSLAKSYGNTYLS

SEQ ID NO: 423 - protein, 16 aa, synthetic construct
RSSQSLAKSYGNTYLS

SEQ ID NO: 424 - protein, 16 aa, synthetic construct
RSSQSLAKSYGNTYLS

SEQ ID NO: 425 - protein, 7 aa, synthetic construct
GISNRFS

SEQ ID NO: 426 - protein, 7 aa, synthetic construct
GISNRFS

SEQ ID NO: 427 - protein, 7 aa, synthetic construct
GISNRFS

SEQ ID NO: 428 - protein, 7 aa, synthetic construct
GISNRFS

SEQ ID NO: 429 - protein, 7 aa, synthetic construct
GISNRFS

SEQ ID NO: 430 - protein, 7 aa, synthetic construct
GISNRFS

SEQ ID NO: 431 - protein, 7 aa, synthetic construct
GISNRFS

SEQ ID NO: 432 - protein, 7 aa, synthetic construct
GISNRFS

SEQ ID NO: 433 - protein, 7 aa, synthetic construct
GISNRFS

SEQ ID NO: 434 - protein, 7 aa, synthetic construct
GISNRFS

SEQ ID NO: 435 - protein, 7 aa, synthetic construct
GISNRFS

SEQ ID NO: 436 - protein, 7 aa, synthetic construct
GISNRFS

SEQ ID NO: 437 - protein, 7 aa, synthetic construct
GISNRFS

SEQ ID NO: 438 - protein, 7 aa, synthetic construct
GISNRFS

SEQ ID NO: 439 - protein, 7 aa, synthetic construct
GISNRFS

SEQ ID NO: 440 - protein, 7 aa, synthetic construct
GISNRFS

SEQ ID NO: 441 - protein, 7 aa, synthetic construct
GISNRFS

SEQ ID NO: 442 - protein, 7 aa, synthetic construct
GISNRFS

SEQ ID NO: 443 - protein, 7 aa, synthetic construct
GISNRFS

SEQ ID NO: 444 - protein, 7 aa, synthetic construct
GISNRFS

SEQ ID NO: 445 - protein, 7 aa, synthetic construct
GISNRFS

SEQ ID NO: 446 - protein, 7 aa, synthetic construct
GISNRFS

SEQ ID NO: 447 - protein, 7 aa, synthetic construct
GISNRFS

SEQ ID NO: 448 - protein, 7 aa, synthetic construct
GISNRFS

SEQ ID NO: 449 - protein, 7 aa, synthetic construct
GISNRFS

SEQ ID NO: 450 - protein, 7 aa, synthetic construct
GISNRFS

SEQ ID NO: 451 - protein, 7 aa, synthetic construct
GISNRFS

SEQ ID NO: 452 - protein, 7 aa, synthetic construct
GISNRFS

SEQ ID NO: 453 - protein, 7 aa, synthetic construct
GISNRFS

SEQ ID NO: 454 - protein, 7 aa, synthetic construct
GISNRFS

SEQ ID NO: 455 - protein, 7 aa, synthetic construct
GISNRFS

SEQ ID NO: 456 - protein, 7 aa, synthetic construct
GISNRFS

SEQ ID NO: 457 - protein, 7 aa, synthetic construct
GISNRFS

SEQ ID NO: 458 - protein, 7 aa, synthetic construct
GISNRFS

SEQ ID NO: 459 - protein, 7 aa, synthetic construct
GISNRFS

SEQ ID NO: 460 - protein, 7 aa, synthetic construct
GISNRFS

SEQ ID NO: 461 - protein, 7 aa, synthetic construct
GISNRFS

SEQ ID NO: 462 - protein, 7 aa, synthetic construct
GISNRFS

SEQ ID NO: 463 - protein, 7 aa, synthetic construct
GISNRFS

SEQ ID NO: 464 - protein, 7 aa, synthetic construct
GISNRFS

SEQ ID NO: 465 - protein, 7 aa, synthetic construct
GISNRFS

SEQ ID NO: 466 - protein, 7 aa, synthetic construct
GISNRFS

SEQ ID NO: 467 - protein, 7 aa, synthetic construct
GISNRFS

SEQ ID NO: 468 - protein, 7 aa, synthetic construct
GISNRFS

SEQ ID NO: 469 - protein, 7 aa, synthetic construct
GISNRFS

SEQ ID NO: 470 - protein, 7 aa, synthetic construct
GISNRFS

SEQ ID NO: 471 - protein, 7 aa, synthetic construct
GISNRFS

SEQ ID NO: 472 - protein, 7 aa, synthetic construct
GISNRFS

SEQ ID NO: 473 - protein, 7 aa, synthetic construct
GISNRFS

SEQ ID NO: 474 - protein, 7 aa, synthetic construct
GISNRFS

SEQ ID NO: 475 - protein, 7 aa, synthetic construct
GISNRFS

SEQ ID NO: 476 - protein, 7 aa, synthetic construct
GISNRFS

SEQ ID NO: 477 - protein, 7 aa, synthetic construct
GISNRFS

SEQ ID NO: 478 - protein, 7 aa, synthetic construct
GISNRFS

SEQ ID NO: 479 - protein, 7 aa, synthetic construct
GISNRFS

SEQ ID NO: 480 - protein, 7 aa, synthetic construct
GISNRFS

SEQ ID NO: 481 - protein, 7 aa, synthetic construct
GISNRFS

SEQ ID NO: 482 - protein, 7 aa, synthetic construct
GISNRFS

SEQ ID NO: 483 - protein, 7 aa, synthetic construct
GISNRFS

SEQ ID NO: 484 - protein, 7 aa, synthetic construct
GISNRFS

SEQ ID NO: 485 - protein, 7 aa, synthetic construct
GISNRFS

SEQ ID NO: 486 - protein, 7 aa, synthetic construct
GISNRFS

SEQ ID NO: 487 - protein, 7 aa, synthetic construct
GISNRFS

SEQ ID NO: 488 - protein, 7 aa, synthetic construct
GISNRFS

SEQ ID NO: 489 - protein, 7 aa, synthetic construct
GISNRFS

SEQ ID NO: 490 - protein, 7 aa, synthetic construct
GISNRFS

SEQ ID NO: 491 - protein, 7 aa, synthetic construct
GISNRFS

SEQ ID NO: 492 - protein, 7 aa, synthetic construct
GISNRFS

SEQ ID NO: 493 - protein, 7 aa, synthetic construct
GISNRFS

SEQ ID NO: 494 - protein, 7 aa, synthetic construct
GISNRFS

SEQ ID NO: 495 - protein, 7 aa, synthetic construct
GISNRFS

SEQ ID NO: 496 - protein, 7 aa, synthetic construct
GISNRFS

SEQ ID NO: 497 - protein, 7 aa, synthetic construct
GISNRFS

SEQ ID NO: 498 - protein, 7 aa, synthetic construct
GISNRFS

SEQ ID NO: 499 - protein, 7 aa, synthetic construct
GISNRFS

SEQ ID NO: 500 - protein, 7 aa, synthetic construct
GISNRFS

SEQ ID NO: 501 - protein, 7 aa, synthetic construct
GISNRFS

SEQ ID NO: 502 - protein, 7 aa, synthetic construct
GISNRFS

SEQ ID NO: 503 - protein, 7 aa, synthetic construct
GISNRFS

SEQ ID NO: 504 - protein, 7 aa, synthetic construct
GISNRFS

SEQ ID NO: 505 - protein, 7 aa, synthetic construct
FISNRFS

SEQ ID NO: 506 - protein, 7 aa, synthetic construct
PISNRFS

SEQ ID NO: 507 - protein, 7 aa, synthetic construct
YISNRFS

SEQ ID NO: 508 - protein, 7 aa, synthetic construct
GISNRFS

SEQ ID NO: 509 - protein, 7 aa, synthetic construct
GISNRFS

SEQ ID NO: 510 - protein, 7 aa, synthetic construct
GISNRFS

SEQ ID NO: 511 - protein, 7 aa, synthetic construct
GISNRFS

SEQ ID NO: 512 - protein, 7 aa, synthetic construct
GISNRFS

SEQ ID NO: 513 - protein, 7 aa, synthetic construct
GISNRFS

SEQ ID NO: 514 - protein, 7 aa, synthetic construct
GISNRFS

SEQ ID NO: 515 - protein, 7 aa, synthetic construct
GISNRFS

SEQ ID NO: 516 - protein, 7 aa, synthetic construct
GISNRFS

SEQ ID NO: 517 - protein, 7 aa, synthetic construct
GISNRFS

SEQ ID NO: 518 - protein, 7 aa, synthetic construct
GISNRFS

SEQ ID NO: 519 - protein, 7 aa, synthetic construct
GISNRFS

SEQ ID NO: 520 - protein, 7 aa, synthetic construct
GISNRFS

SEQ ID NO: 521 - protein, 7 aa, synthetic construct
GISNRFS

SEQ ID NO: 522 - protein, 7 aa, synthetic construct
GISNRFS

SEQ ID NO: 523 - protein, 7 aa, synthetic construct
GISNRFS

SEQ ID NO: 524 - protein, 7 aa, synthetic construct
GISNRFS

SEQ ID NO: 525 - protein, 7 aa, synthetic construct
GISNRFS

SEQ ID NO: 526 - protein, 7 aa, synthetic construct
GISNRFS

SEQ ID NO: 527 - protein, 7 aa, synthetic construct
GISNRFS

SEQ ID NO: 528 - protein, 7 aa, synthetic construct
GISNRFS

SEQ ID NO: 529 - protein, 7 aa, synthetic construct
GISNRFS

SEQ ID NO: 530 - protein, 7 aa, synthetic construct
GISNRFS

SEQ ID NO: 531 - protein, 9 aa, synthetic construct
LQGTHQPYT

SEQ ID NO: 532 - protein, 9 aa, synthetic construct
LQGTHQPYT

SEQ ID NO: 533 - protein, 9 aa, synthetic construct
LQGTHQPYT

SEQ ID NO: 534 - protein, 9 aa, synthetic construct
LQGTHQPYT

SEQ ID NO: 535 - protein, 9 aa, synthetic construct
LQGTHQPYT

SEQ ID NO: 536 - protein, 9 aa, synthetic construct
LQGTHQPYT

SEQ ID NO: 537 - protein, 9 aa, synthetic construct
LQGTHQPYT

SEQ ID NO: 538 - protein, 9 aa, synthetic construct
LQGTHQPYT

SEQ ID NO: 539 - protein, 9 aa, synthetic construct
LQGTHQPYT

SEQ ID NO: 540 - protein, 9 aa, synthetic construct
LQGTHQPYT

SEQ ID NO: 541 - protein, 9 aa, synthetic construct
LQGTHQPYT

SEQ ID NO: 542 - protein, 9 aa, synthetic construct
LQGTHQPYT

SEQ ID NO: 543 - protein, 9 aa, synthetic construct
LQGTHQPYT

SEQ ID NO: 544 - protein, 9 aa, synthetic construct
LQGTHQPYT

SEQ ID NO: 545 - protein, 9 aa, synthetic construct
LQGTHQPYT

SEQ ID NO: 546 - protein, 9 aa, synthetic construct
LQGTHQPYT

SEQ ID NO: 547 - protein, 9 aa, synthetic construct
LQGTHQPYT

SEQ ID NO: 548 - protein, 9 aa, synthetic construct
LQGTHQPYT

SEQ ID NO: 549 - protein, 9 aa, synthetic construct
LQGTHQPYT

SEQ ID NO: 550 - protein, 9 aa, synthetic construct
LQGTHQPYT

SEQ ID NO: 551 - protein, 9 aa, synthetic construct
LQGTHQPYT

SEQ ID NO: 552 - protein, 9 aa, synthetic construct
LQGTHQPYT

SEQ ID NO: 553 - protein, 9 aa, synthetic construct
LQGTHQPYT

SEQ ID NO: 554 - protein, 9 aa, synthetic construct
LQGTHQPYT

SEQ ID NO: 555 - protein, 9 aa, synthetic construct
LQGTHQPYT

SEQ ID NO: 556 - protein, 9 aa, synthetic construct
LQGTHQPYT

SEQ ID NO: 557 - protein, 9 aa, synthetic construct
LQGTHQPYT

SEQ ID NO: 558 - protein, 9 aa, synthetic construct
LQGTHQPYT

SEQ ID NO: 559 - protein, 9 aa, synthetic construct
LQGTHQPYT

SEQ ID NO: 560 - protein, 9 aa, synthetic construct
LQGTHQPYT

SEQ ID NO: 561 - protein, 9 aa, synthetic construct
LQGTHQPYT

SEQ ID NO: 562 - protein, 9 aa, synthetic construct
LQGTHQPYT

SEQ ID NO: 563 - protein, 9 aa, synthetic construct
LQGTHQPYT

SEQ ID NO: 564 - protein, 9 aa, synthetic construct
LQGTHQPYT

SEQ ID NO: 565 - protein, 9 aa, synthetic construct
LQGTHQPYT

SEQ ID NO: 566 - protein, 9 aa, synthetic construct
LQGTHQPYT

SEQ ID NO: 567 - protein, 9 aa, synthetic construct
LQGTHQPYT

SEQ ID NO: 568 - protein, 9 aa, synthetic construct
LQGTHQPYT

SEQ ID NO: 569 - protein, 9 aa, synthetic construct
LQGTHQPYT

SEQ ID NO: 570 - protein, 9 aa, synthetic construct
LQGTHQPYT

SEQ ID NO: 571 - protein, 9 aa, synthetic construct
LQGTHQPYT

SEQ ID NO: 572 - protein, 9 aa, synthetic construct
LQGTHQPYT

SEQ ID NO: 573 - protein, 9 aa, synthetic construct
LQGTHQPYT

SEQ ID NO: 574 - protein, 9 aa, synthetic construct
LQGTHQPYT

SEQ ID NO: 575 - protein, 9 aa, synthetic construct
LQGTHQPYT

SEQ ID NO: 576 - protein, 9 aa, synthetic construct
LQGTHQPYT

SEQ ID NO: 577 - protein, 9 aa, synthetic construct
LQGTHQPYT

SEQ ID NO: 578 - protein, 9 aa, synthetic construct
LQGTHQPYT

SEQ ID NO: 579 - protein, 9 aa, synthetic construct
LQGTHQPYT

SEQ ID NO: 580 - protein, 9 aa, synthetic construct
LQGTHQPYT

SEQ ID NO: 581 - protein, 9 aa, synthetic construct
LQGTHQPYT

SEQ ID NO: 582 - protein, 9 aa, synthetic construct
LQGTHQPYT

SEQ ID NO: 583 - protein, 9 aa, synthetic construct
LQGTHQPYT

SEQ ID NO: 584 - protein, 9 aa, synthetic construct
LQGTHQPYT

SEQ ID NO: 585 - protein, 9 aa, synthetic construct
LQGTHQPYT

SEQ ID NO: 586 - protein, 9 aa, synthetic construct
LQGTHQPYT

SEQ ID NO: 587 - protein, 9 aa, synthetic construct
LQGTHQPYT

SEQ ID NO: 588 - protein, 9 aa, synthetic construct
LQGTHQPYT

SEQ ID NO: 589 - protein, 9 aa, synthetic construct
LQGTHQPYT

SEQ ID NO: 590 - protein, 9 aa, synthetic construct
LQGTHQPYT

SEQ ID NO: 591 - protein, 9 aa, synthetic construct
LQGTHQPYT

SEQ ID NO: 592 - protein, 9 aa, synthetic construct
LQGTHQPYT

SEQ ID NO: 593 - protein, 9 aa, synthetic construct
LQGTHQPYT

SEQ ID NO: 594 - protein, 9 aa, synthetic construct
LQGTHQPYT

SEQ ID NO: 595 - protein, 9 aa, synthetic construct
LQGTHQPYT

SEQ ID NO: 596 - protein, 9 aa, synthetic construct
LQGTHQPYT

SEQ ID NO: 597 - protein, 9 aa, synthetic construct
LQGTHQPYT

SEQ ID NO: 598 - protein, 9 aa, synthetic construct
LQGTHQPYT

SEQ ID NO: 599 - protein, 9 aa, synthetic construct
LQGTHQPYT

SEQ ID NO: 600 - protein, 9 aa, synthetic construct
LQGTHQPYT

SEQ ID NO: 601 - protein, 9 aa, synthetic construct
LQGTHQPYT

SEQ ID NO: 602 - protein, 9 aa, synthetic construct
LQGTHQPYT

SEQ ID NO: 603 - protein, 9 aa, synthetic construct
LQGTHQPYT

SEQ ID NO: 604 - protein, 9 aa, synthetic construct
LQGTHQPYT

SEQ ID NO: 605 - protein, 9 aa, synthetic construct
LQGTHQPYT

SEQ ID NO: 606 - protein, 9 aa, synthetic construct
LQGTHQPYT

SEQ ID NO: 607 - protein, 9 aa, synthetic construct
LQGTHQPYT

SEQ ID NO: 608 - protein, 9 aa, synthetic construct
LQGTHQPYT

SEQ ID NO: 609 - protein, 9 aa, synthetic construct
LQGTHQPYT

SEQ ID NO: 610 - protein, 9 aa, synthetic construct
LQGTHQPYT

SEQ ID NO: 611 - protein, 9 aa, synthetic construct
LQGTHQPYT

SEQ ID NO: 612 - protein, 9 aa, synthetic construct
LQGTHQPYT

SEQ ID NO: 613 - protein, 9 aa, synthetic construct
LQGTHQPYT

SEQ ID NO: 614 - protein, 9 aa, synthetic construct
LQFTHQPYT

SEQ ID NO: 615 - protein, 9 aa, synthetic construct
LQFTIQFYT

SEQ ID NO: 616 - protein, 9 aa, synthetic construct
LQFTIQVYT

SEQ ID NO: 617 - protein, 9 aa, synthetic construct
LQFTIQPYI

SEQ ID NO: 618 - protein, 9 aa, synthetic construct
LQFTHQFYT

SEQ ID NO: 619 - protein, 9 aa, synthetic construct
LQFTHQIYI

SEQ ID NO: 620 - protein, 9 aa, synthetic construct
LQFTHQPYI

SEQ ID NO: 621 - protein, 9 aa, synthetic construct
LQRTHQPYT

SEQ ID NO: 622 - protein, 9 aa, synthetic construct
LQRTIQVYI

SEQ ID NO: 623 - protein, 9 aa, synthetic construct
LQRTIQYYT

SEQ ID NO: 624 - protein, 9 aa, synthetic construct
LQVTHQPYT

SEQ ID NO: 625 - protein, 9 aa, synthetic construct
LQWTHQPYT

SEQ ID NO: 626 - protein, 9 aa, synthetic construct
LQYTHQPYT

SEQ ID NO: 627 - protein, 9 aa, synthetic construct
LQYTIQFYI

SEQ ID NO: 628 - protein, 9 aa, synthetic construct
LQYTHQFYI

SEQ ID NO: 629 - protein, 9 aa, synthetic construct
LQGTIQPYT

SEQ ID NO: 630 - protein, 9 aa, synthetic construct
LQGTWQPYT

SEQ ID NO: 631 - protein, 9 aa, synthetic construct
LQGTHQFYT

SEQ ID NO: 632 - protein, 9 aa, synthetic construct
LQGTHQIYT

SEQ ID NO: 633 - protein, 9 aa, synthetic construct
LQGTHQVYT

SEQ ID NO: 634 - protein, 9 aa, synthetic construct
LQGTHQYYT

SEQ ID NO: 635 - protein, 9 aa, synthetic construct
LQGTHQPYI

SEQ ID NO: 636 - protein, 9 aa, synthetic construct
LQGTHQPYR

SEQ ID NO: 637 - protein, 10 aa, synthetic construct
GGTFTSYWMH

SEQ ID NO: 638 - protein, 10 aa, synthetic construct
GYTFTSYWMH

SEQ ID NO: 639 - protein, 10 aa, synthetic construct
GYTFTIYWMH

SEQ ID NO: 640 - protein, 10 aa, synthetic construct
GYTFTVYWMH

SEQ ID NO: 641 - protein, 10 aa, synthetic construct
GYTFTSMWMH

SEQ ID NO: 642 - protein, 10 aa, synthetic construct
GYTFTSQWMH

SEQ ID NO: 643 - protein, 10 aa, synthetic construct
GYTFTSYWMH

SEQ ID NO: 644 - protein, 10 aa, synthetic construct
GYTFTSYWMH

SEQ ID NO: 645 - protein, 10 aa, synthetic construct
GYTFTSYWMH

SEQ ID NO: 646 - protein, 10 aa, synthetic construct
GYTFTSYWMH

SEQ ID NO: 647 - protein, 10 aa, synthetic construct
GYTFTSYWMH

SEQ ID NO: 648 - protein, 10 aa, synthetic construct
GYTFTSYWMH

SEQ ID NO: 649 - protein, 10 aa, synthetic construct
GYTFTSYWMH

SEQ ID NO: 650 - protein, 10 aa, synthetic construct
GYTFTSYWMH

SEQ ID NO: 651 - protein, 10 aa, synthetic construct
GYTFTSYWMH

SEQ ID NO: 652 - protein, 10 aa, synthetic construct
GYTFTSYWMH

SEQ ID NO: 653 - protein, 10 aa, synthetic construct
GYTFTSYWMH

SEQ ID NO: 654 - protein, 10 aa, synthetic construct
GYTFTSYWMH

SEQ ID NO: 655 - protein, 10 aa, synthetic construct
GYTFTSYWMH

SEQ ID NO: 656 - protein, 10 aa, synthetic construct
GYTFTSYWMH

SEQ ID NO: 657 - protein, 10 aa, synthetic construct
GYTFTSYWMH

SEQ ID NO: 658 - protein, 10 aa, synthetic construct
GYTFTSYWMH

SEQ ID NO: 659 - protein, 10 aa, synthetic construct
GYTFTSYWMH

SEQ ID NO: 660 - protein, 10 aa, synthetic construct
GYTFTSYWMH

SEQ ID NO: 661 - protein, 10 aa, synthetic construct
GYTFTSYWMH

SEQ ID NO: 662 - protein, 10 aa, synthetic construct
GYTFTSYWMH

SEQ ID NO: 663 - protein, 10 aa, synthetic construct
GYTFTSYWMH

SEQ ID NO: 664 - protein, 10 aa, synthetic construct
GYTFTSYWMH

SEQ ID NO: 665 - protein, 10 aa, synthetic construct
GYTFTSYWMH

SEQ ID NO: 666 - protein, 10 aa, synthetic construct
GYTFTSYWMH

SEQ ID NO: 667 - protein, 10 aa, synthetic construct
GYTFTSYWMH

SEQ ID NO: 668 - protein, 10 aa, synthetic construct
GYTFTSYWMH

SEQ ID NO: 669 - protein, 10 aa, synthetic construct
GYTFTSYWMH

SEQ ID NO: 670 - protein, 10 aa, synthetic construct
GYTFTSYWMH

SEQ ID NO: 671 - protein, 10 aa, synthetic construct
GYTFTSYWMH

SEQ ID NO: 672 - protein, 10 aa, synthetic construct
GYTFTSYWMH

SEQ ID NO: 673 - protein, 10 aa, synthetic construct
GYTFTSYWMH

SEQ ID NO: 674 - protein, 10 aa, synthetic construct
GYTFTSYWMH

SEQ ID NO: 675 - protein, 10 aa, synthetic construct
GYTFTSYWMH

SEQ ID NO: 676 - protein, 10 aa, synthetic construct
GYTFTSYWMH

SEQ ID NO: 677 - protein, 10 aa, synthetic construct
GYTFTSYWMH

SEQ ID NO: 678 - protein, 10 aa, synthetic construct
GYTFTSYWMH

SEQ ID NO: 679 - protein, 10 aa, synthetic construct
GYTFTSYWMH

SEQ ID NO: 680 - protein, 10 aa, synthetic construct
GYTFTSYWMH

SEQ ID NO: 681 - protein, 10 aa, synthetic construct
GYTFTSYWMH

SEQ ID NO: 682 - protein, 10 aa, synthetic construct
GYTFTSYWMH

SEQ ID NO: 683 - protein, 10 aa, synthetic construct
GYTFTSYWMH

SEQ ID NO: 684 - protein, 10 aa, synthetic construct
GYTFTSYWMH

SEQ ID NO: 685 - protein, 10 aa, synthetic construct
GYTFTSYWMH

SEQ ID NO: 686 - protein, 10 aa, synthetic construct
GYTFTSYWMH

SEQ ID NO: 687 - protein, 10 aa, synthetic construct
GYTFTSYWMH

SEQ ID NO: 688 - protein, 10 aa, synthetic construct
GYTFTSYWMH

SEQ ID NO: 689 - protein, 10 aa, synthetic construct
GYTFTSYWMH

SEQ ID NO: 690 - protein, 10 aa, synthetic construct
GYTFTSYWMH

SEQ ID NO: 691 - protein, 10 aa, synthetic construct
GYTFTSYWMH

SEQ ID NO: 692 - protein, 10 aa, synthetic construct
GYTFTSYWMH

SEQ ID NO: 693 - protein, 10 aa, synthetic construct
GYTFTSYWMH

SEQ ID NO: 694 - protein, 10 aa, synthetic construct
GYTFTSYWMH

SEQ ID NO: 695 - protein, 10 aa, synthetic construct
GYTFTSYWMH

SEQ ID NO: 696 - protein, 10 aa, synthetic construct
GYTFTSYWMH

SEQ ID NO: 697 - protein, 10 aa, synthetic construct
GYTFTSYWMH

SEQ ID NO: 698 - protein, 10 aa, synthetic construct
GYTFTSYWMH

SEQ ID NO: 699 - protein, 10 aa, synthetic construct
GYTFTSYWMH

SEQ ID NO: 700 - protein, 10 aa, synthetic construct
GYTFTSYWMH

SEQ ID NO: 701 - protein, 10 aa, synthetic construct
GYTFTSYWMH

SEQ ID NO: 702 - protein, 10 aa, synthetic construct
GYTFTSYWMH

SEQ ID NO: 703 - protein, 10 aa, synthetic construct
GYTFTSYWMH

SEQ ID NO: 704 - protein, 10 aa, synthetic construct
GYTFTSYWMH

SEQ ID NO: 705 - protein, 10 aa, synthetic construct
GYTFTSYWMH

SEQ ID NO: 706 - protein, 10 aa, synthetic construct
GYTFTSYWMH

SEQ ID NO: 707 - protein, 10 aa, synthetic construct
GYTFTSYWMH

SEQ ID NO: 708 - protein, 10 aa, synthetic construct
GYTFTSYWMH

SEQ ID NO: 709 - protein, 10 aa, synthetic construct
GYTFTSYWMH

SEQ ID NO: 710 - protein, 10 aa, synthetic construct
GYTFTSYWMH

SEQ ID NO: 711 - protein, 10 aa, synthetic construct
GYTFTSYWMH

SEQ ID NO: 712 - protein, 10 aa, synthetic construct
GYTFTSYWMH

SEQ ID NO: 713 - protein, 10 aa, synthetic construct
GYTFTSYWMH

SEQ ID NO: 714 - protein, 10 aa, synthetic construct
GYTFTSYWMH

SEQ ID NO: 715 - protein, 10 aa, synthetic construct
GYTFTSYWMH

SEQ ID NO: 716 - protein, 10 aa, synthetic construct
GYTFTSYWMH

SEQ ID NO: 717 - protein, 10 aa, synthetic construct
GYTFTSYWMH

SEQ ID NO: 718 - protein, 10 aa, synthetic construct
GYTFTSYWMH

SEQ ID NO: 719 - protein, 10 aa, synthetic construct
GYTFTSYWMH

SEQ ID NO: 720 - protein, 10 aa, synthetic construct
GYTFTSYWMH

SEQ ID NO: 721 - protein, 10 aa, synthetic construct
GYTFTSYWMH

SEQ ID NO: 722 - protein, 10 aa, synthetic construct
GYTFTSYWMH

SEQ ID NO: 723 - protein, 10 aa, synthetic construct
GYTFTSYWMH

SEQ ID NO: 724 - protein, 10 aa, synthetic construct
GYTFTSYWMH

SEQ ID NO: 725 - protein, 10 aa, synthetic construct
GYTFTSYWMH

SEQ ID NO: 726 - protein, 10 aa, synthetic construct
GYTFTSYWMH

SEQ ID NO: 727 - protein, 10 aa, synthetic construct
GYTFTSYWMH

SEQ ID NO: 728 - protein, 10 aa, synthetic construct
GYTFTSYWMH

SEQ ID NO: 729 - protein, 10 aa, synthetic construct
GYTFTSYWMH

SEQ ID NO: 730 - protein, 10 aa, synthetic construct
GYTFTSYWMH

SEQ ID NO: 731 - protein, 10 aa, synthetic construct
GYTFTSYWMH

SEQ ID NO: 732 - protein, 10 aa, synthetic construct
GYTFTSYWMH

SEQ ID NO: 733 - protein, 10 aa, synthetic construct
GYTFTSYWMH

SEQ ID NO: 734 - protein, 10 aa, synthetic construct
GYTFTSYWMH

SEQ ID NO: 735 - protein, 10 aa, synthetic construct
GYTFTSYWMH

SEQ ID NO: 736 - protein, 10 aa, synthetic construct
GYTFTSYWMH

SEQ ID NO: 737 - protein, 10 aa, synthetic construct
GYTFTSYWMH

SEQ ID NO: 738 - protein, 10 aa, synthetic construct
GYTFTSYWMH

SEQ ID NO: 739 - protein, 10 aa, synthetic construct
GYTFTSYWMH

SEQ ID NO: 740 - protein, 10 aa, synthetic construct
GYTFTSYWMH

SEQ ID NO: 741 - protein, 10 aa, synthetic construct
GYTFTSYWMH

SEQ ID NO: 742 - protein, 10 aa, synthetic construct
GYTFTSYWMH

SEQ ID NO: 743 - protein, 6 aa, synthetic construct
DPSESN

SEQ ID NO: 744 - protein, 6 aa, synthetic construct
DPSESN

SEQ ID NO: 745 - protein, 6 aa, synthetic construct
DPSESN

SEQ ID NO: 746 - protein, 6 aa, synthetic construct
DPSESN

SEQ ID NO: 747 - protein, 6 aa, synthetic construct
DPSESN

SEQ ID NO: 748 - protein, 6 aa, synthetic construct
DPSESN

SEQ ID NO: 749 - protein, 6 aa, synthetic construct
IPSESN

SEQ ID NO: 750 - protein, 6 aa, synthetic construct
IPLESN

SEQ ID NO: 751 - protein, 6 aa, synthetic construct
IPRESN

SEQ ID NO: 752 - protein, 6 aa, synthetic construct
IPVESN

SEQ ID NO: 753 - protein, 6 aa, synthetic construct
RPSESN

SEQ ID NO: 754 - protein, 6 aa, synthetic construct
RPLESN

SEQ ID NO: 755 - protein, 6 aa, synthetic construct
RPRESN

SEQ ID NO: 756 - protein, 6 aa, synthetic construct
RPVESN

SEQ ID NO: 757 - protein, 6 aa, synthetic construct
DPLESN

SEQ ID NO: 758 - protein, 6 aa, synthetic construct
DPMESN

SEQ ID NO: 759 - protein, 6 aa, synthetic construct
DPRESN

SEQ ID NO: 760 - protein, 6 aa, synthetic construct
DPVESN

SEQ ID NO: 761 - protein, 6 aa, synthetic construct
DPSESN

SEQ ID NO: 762 - protein, 6 aa, synthetic construct
DPSESN

SEQ ID NO: 763 - protein, 6 aa, synthetic construct
DPSESN

SEQ ID NO: 764 - protein, 6 aa, synthetic construct
DPSESN

SEQ ID NO: 765 - protein, 6 aa, synthetic construct
DPSESN

SEQ ID NO: 766 - protein, 6 aa, synthetic construct
DPSESN

SEQ ID NO: 767 - protein, 6 aa, synthetic construct
DPSESN

SEQ ID NO: 768 - protein, 6 aa, synthetic construct
DPSESN

SEQ ID NO: 769 - protein, 6 aa, synthetic construct
DPSESN

SEQ ID NO: 770 - protein, 6 aa, synthetic construct
DPSESN

SEQ ID NO: 771 - protein, 6 aa, synthetic construct
DPSESN

SEQ ID NO: 772 - protein, 6 aa, synthetic construct
DPSESN

SEQ ID NO: 773 - protein, 6 aa, synthetic construct
DPSESN

SEQ ID NO: 774 - protein, 6 aa, synthetic construct
DPSESN

SEQ ID NO: 775 - protein, 6 aa, synthetic construct
DPSESN

SEQ ID NO: 776 - protein, 6 aa, synthetic construct
DPSESN

SEQ ID NO: 777 - protein, 6 aa, synthetic construct
DPSESN

SEQ ID NO: 778 - protein, 6 aa, synthetic construct
DPSESN

SEQ ID NO: 779 - protein, 6 aa, synthetic construct
DPSESN

SEQ ID NO: 780 - protein, 6 aa, synthetic construct
DPSESN

SEQ ID NO: 781 - protein, 6 aa, synthetic construct
DPSESN

SEQ ID NO: 782 - protein, 6 aa, synthetic construct
DPSESN

SEQ ID NO: 783 - protein, 6 aa, synthetic construct
DPSESN

SEQ ID NO: 784 - protein, 6 aa, synthetic construct
DPSESN

SEQ ID NO: 785 - protein, 6 aa, synthetic construct
DPSESN

SEQ ID NO: 786 - protein, 6 aa, synthetic construct
DPSESN

SEQ ID NO: 787 - protein, 6 aa, synthetic construct
DPSESN

SEQ ID NO: 788 - protein, 6 aa, synthetic construct
DPSESN

SEQ ID NO: 789 - protein, 6 aa, synthetic construct
DPSESN

SEQ ID NO: 790 - protein, 6 aa, synthetic construct
DPSESN

SEQ ID NO: 791 - protein, 6 aa, synthetic construct
DPSESN

SEQ ID NO: 792 - protein, 6 aa, synthetic construct
DPSESN

SEQ ID NO: 793 - protein, 6 aa, synthetic construct
DPSESN

SEQ ID NO: 794 - protein, 6 aa, synthetic construct
DPSESN

SEQ ID NO: 795 - protein, 6 aa, synthetic construct
DPSESN

SEQ ID NO: 796 - protein, 6 aa, synthetic construct
DPSESN

SEQ ID NO: 797 - protein, 6 aa, synthetic construct
DPSESN

SEQ ID NO: 798 - protein, 6 aa, synthetic construct
DPSESN

SEQ ID NO: 799 - protein, 6 aa, synthetic construct
DPSESN

SEQ ID NO: 800 - protein, 6 aa, synthetic construct
DPSESN

SEQ ID NO: 801 - protein, 6 aa, synthetic construct
DPSESN

SEQ ID NO: 802 - protein, 6 aa, synthetic construct
DPSESN

SEQ ID NO: 803 - protein, 6 aa, synthetic construct
DPSESN

SEQ ID NO: 804 - protein, 6 aa, synthetic construct
DPSESN

SEQ ID NO: 805 - protein, 6 aa, synthetic construct
DPSESN

SEQ ID NO: 806 - protein, 6 aa, synthetic construct
DPSESN

SEQ ID NO: 807 - protein, 6 aa, synthetic construct
DPSESN

SEQ ID NO: 808 - protein, 6 aa, synthetic construct
DPSESN

SEQ ID NO: 809 - protein, 6 aa, synthetic construct
DPSESN

SEQ ID NO: 810 - protein, 6 aa, synthetic construct
DPSESN

SEQ ID NO: 811 - protein, 6 aa, synthetic construct
DPSESN

SEQ ID NO: 812 - protein, 6 aa, synthetic construct
DPSESN

SEQ ID NO: 813 - protein, 6 aa, synthetic construct
DPSESN

SEQ ID NO: 814 - protein, 6 aa, synthetic construct
DPSESN

SEQ ID NO: 815 - protein, 6 aa, synthetic construct
DPSESN

SEQ ID NO: 816 - protein, 6 aa, synthetic construct
DPSESN

SEQ ID NO: 817 - protein, 6 aa, synthetic construct
DPSESN

SEQ ID NO: 818 - protein, 6 aa, synthetic construct
DPSESN

SEQ ID NO: 819 - protein, 6 aa, synthetic construct
DPSESN

SEQ ID NO: 820 - protein, 6 aa, synthetic construct
DPSESN

SEQ ID NO: 821 - protein, 6 aa, synthetic construct
DPSESN

SEQ ID NO: 822 - protein, 6 aa, synthetic construct
DPSESN

SEQ ID NO: 823 - protein, 6 aa, synthetic construct
DPSESN

SEQ ID NO: 824 - protein, 6 aa, synthetic construct
DPSESN

SEQ ID NO: 825 - protein, 6 aa, synthetic construct
DPSESN

SEQ ID NO: 826 - protein, 6 aa, synthetic construct
DPSESN

SEQ ID NO: 827 - protein, 6 aa, synthetic construct
DPSESN

SEQ ID NO: 828 - protein, 6 aa, synthetic construct
DPSESN

SEQ ID NO: 829 - protein, 6 aa, synthetic construct
DPSESN

SEQ ID NO: 830 - protein, 6 aa, synthetic construct
DPSESN

SEQ ID NO: 831 - protein, 6 aa, synthetic construct
DPSESN

SEQ ID NO: 832 - protein, 6 aa, synthetic construct
DPSESN

SEQ ID NO: 833 - protein, 6 aa, synthetic construct
DPSESN

SEQ ID NO: 834 - protein, 6 aa, synthetic construct
DPSESN

SEQ ID NO: 835 - protein, 6 aa, synthetic construct
DPSESN

SEQ ID NO: 836 - protein, 6 aa, synthetic construct
DPSESN

SEQ ID NO: 837 - protein, 6 aa, synthetic construct
DPSESN

SEQ ID NO: 838 - protein, 6 aa, synthetic construct
DPSESN

SEQ ID NO: 839 - protein, 6 aa, synthetic construct
DPSESN

SEQ ID NO: 840 - protein, 6 aa, synthetic construct
DPSESN

SEQ ID NO: 841 - protein, 6 aa, synthetic construct
DPSESN

SEQ ID NO: 842 - protein, 6 aa, synthetic construct
DPSESN

SEQ ID NO: 843 - protein, 6 aa, synthetic construct
DPSESN

SEQ ID NO: 844 - protein, 6 aa, synthetic construct
DPSESN

SEQ ID NO: 845 - protein, 6 aa, synthetic construct
DPSESN

SEQ ID NO: 846 - protein, 6 aa, synthetic construct
DPSESN

SEQ ID NO: 847 - protein, 6 aa, synthetic construct
DPSESN

SEQ ID NO: 848 - protein, 6 aa, synthetic construct
DPSESN

SEQ ID NO: 849 - protein, 12 aa, synthetic construct
GGYDGWDYAIDY

SEQ ID NO: 850 - protein, 12 aa, synthetic construct
GGYDGWDYAIDY

SEQ ID NO: 851 - protein, 12 aa, synthetic construct
GGYDGWDYAIDY

SEQ ID NO: 852 - protein, 12 aa, synthetic construct
GGYDGWDYAIDY

SEQ ID NO: 853 - protein, 12 aa, synthetic construct
GGYDGWDYAIDY

SEQ ID NO: 854 - protein, 12 aa, synthetic construct
GGYDGWDYAIDY

SEQ ID NO: 855 - protein, 12 aa, synthetic construct
GGYDGWDYAIDY

SEQ ID NO: 856 - protein, 12 aa, synthetic construct
GGYDGWDYAIDY

SEQ ID NO: 857 - protein, 12 aa, synthetic construct
GGYDGWDYAIDY

SEQ ID NO: 858 - protein, 12 aa, synthetic construct
GGYDGWDYAIDY

SEQ ID NO: 859 - protein, 12 aa, synthetic construct
GGYDGWDYAIDY

SEQ ID NO: 860 - protein, 12 aa, synthetic construct
GGYDGWDYAIDY

SEQ ID NO: 861 - protein, 12 aa, synthetic construct
GGYDGWDYAIDY

SEQ ID NO: 862 - protein, 12 aa, synthetic construct
GGYDGWDYAIDY

SEQ ID NO: 863 - protein, 12 aa, synthetic construct
GGYDGWDYAIDY

SEQ ID NO: 864 - protein, 12 aa, synthetic construct
GGYDGWDYAIDY

SEQ ID NO: 865 - protein, 12 aa, synthetic construct
GGYDGWDYAIDY

SEQ ID NO: 866 - protein, 12 aa, synthetic construct
GGYDGWDYAIDY

SEQ ID NO: 867 - protein, 12 aa, synthetic construct
GGYDGWDYFIDY

SEQ ID NO: 868 - protein, 12 aa, synthetic construct
GGYDGWDYFIYY

SEQ ID NO: 869 - protein, 12 aa, synthetic construct
GGYDGWDYLIDY

SEQ ID NO: 870 - protein, 12 aa, synthetic construct
GGYDGWDYVIDY

SEQ ID NO: 871 - protein, 12 aa, synthetic construct
GGYDGWDYVIYY

SEQ ID NO: 872 - protein, 12 aa, synthetic construct
GGYDGWDYWIDY

SEQ ID NO: 873 - protein, 12 aa, synthetic construct
GGYDGWDYYIDY

SEQ ID NO: 874 - protein, 12 aa, synthetic construct
GGYDGWDYYIYY

SEQ ID NO: 875 - protein, 12 aa, synthetic construct
GGYDGWDYAIDY

SEQ ID NO: 876 - protein, 12 aa, synthetic construct
GGYDGWDYAIDY

SEQ ID NO: 877 - protein, 12 aa, synthetic construct
GGYDGWDYAIDY

SEQ ID NO: 878 - protein, 12 aa, synthetic construct
GGYDGWDYAIDY

SEQ ID NO: 879 - protein, 12 aa, synthetic construct
GGYDGWDYAIDY

SEQ ID NO: 880 - protein, 12 aa, synthetic construct
GGYWGWDYAIDY

SEQ ID NO: 881 - protein, 12 aa, synthetic construct
GGYYGWDYAIDY

SEQ ID NO: 882 - protein, 12 aa, synthetic construct
GGYDGWDYAIFY

SEQ ID NO: 883 - protein, 12 aa, synthetic construct
GGYDGWDYAIMY

SEQ ID NO: 884 - protein, 12 aa, synthetic construct
GGYDGWDYAIWY

SEQ ID NO: 885 - protein, 12 aa, synthetic construct
GGYDGWDYAIYY

SEQ ID NO: 886 - protein, 12 aa, synthetic construct
GFYDGWDYAIDY

SEQ ID NO: 887 - protein, 12 aa, synthetic construct
GFYDGWDYLIDY

SEQ ID NO: 888 - protein, 12 aa, synthetic construct
GFYDGWDYAIYY

SEQ ID NO: 889 - protein, 12 aa, synthetic construct
GMYDGWDYAIDY

SEQ ID NO: 890 - protein, 12 aa, synthetic construct
GRYDGWDYAIDY

SEQ ID NO: 891 - protein, 12 aa, synthetic construct
GVYDGWDYAIDY

SEQ ID NO: 892 - protein, 12 aa, synthetic construct
GGYDIWDYAIDY

SEQ ID NO: 893 - protein, 12 aa, synthetic construct
GGYDLWDYAIDY

SEQ ID NO: 894 - protein, 12 aa, synthetic construct
GGYDVWDYAIDY

SEQ ID NO: 895 - protein, 12 aa, synthetic construct
FGYDGWDYAIDY

SEQ ID NO: 896 - protein, 12 aa, synthetic construct
YGYDGWDYAIDY

SEQ ID NO: 897 - protein, 12 aa, synthetic construct
GGYDGWDYAIDY

SEQ ID NO: 898 - protein, 12 aa, synthetic construct
GGYDGWDYAIDY

SEQ ID NO: 899 - protein, 12 aa, synthetic construct
GGYDGWDYAIDY

SEQ ID NO: 900 - protein, 12 aa, synthetic construct
GGYDGWDYAIDY

SEQ ID NO: 901 - protein, 12 aa, synthetic construct
GGYDGWDYAIDY

SEQ ID NO: 902 - protein, 12 aa, synthetic construct
GGYDGWDYAIDY

SEQ ID NO: 903 - protein, 12 aa, synthetic construct
GGYDGWDYAIDY

SEQ ID NO: 904 - protein, 12 aa, synthetic construct
GGYDGWDYAIDY

SEQ ID NO: 905 - protein, 12 aa, synthetic construct
GGYDGWDYAIDY

SEQ ID NO: 906 - protein, 12 aa, synthetic construct
GGYDGWDYAIDY

SEQ ID NO: 907 - protein, 12 aa, synthetic construct
GGYDGWDYAIDY

SEQ ID NO: 908 - protein, 12 aa, synthetic construct
GGYDGWDYAIDY

SEQ ID NO: 909 - protein, 12 aa, synthetic construct
GGYDGWDYAIDY

SEQ ID NO: 910 - protein, 12 aa, synthetic construct
GGYDGWDYAIDY

SEQ ID NO: 911 - protein, 12 aa, synthetic construct
GGYDGWDYAIDY

SEQ ID NO: 912 - protein, 12 aa, synthetic construct
GGYDGWDYAIDY

SEQ ID NO: 913 - protein, 12 aa, synthetic construct
GGYDGWDYAIDY

SEQ ID NO: 914 - protein, 12 aa, synthetic construct
GGYDGWDYAIDY

SEQ ID NO: 915 - protein, 12 aa, synthetic construct
GGYDGWDYAIDY

SEQ ID NO: 916 - protein, 12 aa, synthetic construct
GGYDGWDYAIDY

SEQ ID NO: 917 - protein, 12 aa, synthetic construct
GGYDGWDYAIDY

SEQ ID NO: 918 - protein, 12 aa, synthetic construct
GGYDGWDYAIDY

SEQ ID NO: 919 - protein, 12 aa, synthetic construct
GGYDGWDYAIDY

SEQ ID NO: 920 - protein, 12 aa, synthetic construct
GGYDGWDYAIDY

SEQ ID NO: 921 - protein, 12 aa, synthetic construct
GGYDGWDYAIDY

SEQ ID NO: 922 - protein, 12 aa, synthetic construct
GGYDGWDYAIDY

SEQ ID NO: 923 - protein, 12 aa, synthetic construct
GGYDGWDYAIDY

SEQ ID NO: 924 - protein, 12 aa, synthetic construct
GGYDGWDYAIDY

SEQ ID NO: 925 - protein, 12 aa, synthetic construct
GGYDGWDYAIDY

SEQ ID NO: 926 - protein, 12 aa, synthetic construct
GGYDGWDYAIDY

SEQ ID NO: 927 - protein, 12 aa, synthetic construct
GGYDGWDYAIDY

SEQ ID NO: 928 - protein, 12 aa, synthetic construct
GGYDGWDYAIDY

SEQ ID NO: 929 - protein, 12 aa, synthetic construct
GGYDGWDYAIDY

SEQ ID NO: 930 - protein, 12 aa, synthetic construct
GGYDGWDYAIDY

SEQ ID NO: 931 - protein, 12 aa, synthetic construct
GGYDGWDYAIDY

SEQ ID NO: 932 - protein, 12 aa, synthetic construct
GGYDGWDYAIDY

SEQ ID NO: 933 - protein, 12 aa, synthetic construct
GGYDGWDYAIDY

SEQ ID NO: 934 - protein, 12 aa, synthetic construct
GGYDGWDYAIDY

SEQ ID NO: 935 - protein, 12 aa, synthetic construct
GGYDGWDYAIDY

SEQ ID NO: 936 - protein, 12 aa, synthetic construct
GGYDGWDYAIDY

SEQ ID NO: 937 - protein, 12 aa, synthetic construct
GGYDGWDYAIDY

SEQ ID NO: 938 - protein, 12 aa, synthetic construct
GGYDGWDYAIDY

SEQ ID NO: 939 - protein, 12 aa, synthetic construct
GGYDGWDYAIDY

SEQ ID NO: 940 - protein, 12 aa, synthetic construct
GGYDGWDYAIDY

SEQ ID NO: 941 - protein, 12 aa, synthetic construct
GGYDGWDYAIDY

SEQ ID NO: 942 - protein, 12 aa, synthetic construct
GGYDGWDYAIDY

SEQ ID NO: 943 - protein, 12 aa, synthetic construct
GGYDGWDYAIDY

SEQ ID NO: 944 - protein, 12 aa, synthetic construct
GGYDGWDYAIDY

SEQ ID NO: 945 - protein, 12 aa, synthetic construct
GGYDGWDYAIDY

SEQ ID NO: 946 - protein, 12 aa, synthetic construct
GGYDGWDYAIDY

SEQ ID NO: 947 - protein, 12 aa, synthetic construct
GGYDGWDYAIDY

SEQ ID NO: 948 - protein, 12 aa, synthetic construct
GGYDGWDYAIDY

SEQ ID NO: 949 - protein, 12 aa, synthetic construct
GGYDGWDYAIDY

SEQ ID NO: 950 - protein, 12 aa, synthetic construct
GGYDGWDYAIDY

SEQ ID NO: 951 - protein, 12 aa, synthetic construct
GGYDGWDYAIDY

SEQ ID NO: 952 - protein, 12 aa, synthetic construct
GGYDGWDYAIDY

SEQ ID NO: 953 - protein, 12 aa, synthetic construct
GGYDGWDYAIDY

SEQ ID NO: 954 - protein, 12 aa, synthetic construct
GGYDGWDYAIDY

SEQ ID NO: 955 - protein, 16 aa, synthetic construct
RSSQSLAKSYGNTYLS

SEQ ID NO: 956 - protein, 16 aa, synthetic construct
RSSQSLAKSYGNTYLS

SEQ ID NO: 957 - protein, 16 aa, synthetic construct
RSSQSLAKSYGNTYLS

SEQ ID NO: 958 - protein, 16 aa, synthetic construct
RSSQSLAKSYGNTYLS

SEQ ID NO: 959 - protein, 16 aa, synthetic construct
RSSQSLAKSYGNTYLS

SEQ ID NO: 960 - protein, 16 aa, synthetic construct
RSSQSLAKSYGNTYLS

SEQ ID NO: 961 - protein, 16 aa, synthetic construct
RSSQSLAKSYGNTYLS

SEQ ID NO: 962 - protein, 16 aa, synthetic construct
RSSQSLAKSYGNTYLS

SEQ ID NO: 963 - protein, 16 aa, synthetic construct
RSSQSLAKSYGNTYLS

SEQ ID NO: 964 - protein, 16 aa, synthetic construct
RSSQSLAKSYGNTYLS

SEQ ID NO: 965 - protein, 16 aa, synthetic construct
RSSQSLAKSYGNTYLS

SEQ ID NO: 966 - protein, 16 aa, synthetic construct
RSSQSLAKSYGNTYLS

SEQ ID NO: 967 - protein, 16 aa, synthetic construct
RSSQSLAKSYGNTYLS

SEQ ID NO: 968 - protein, 16 aa, synthetic construct
RSSQSLAKSYGNTYLS

SEQ ID NO: 969 - protein, 16 aa, synthetic construct
RSSQSLAKSYGNTYLS

SEQ ID NO: 970 - protein, 16 aa, synthetic construct
RSSQSLAKSYGNTYLS

SEQ ID NO: 971 - protein, 16 aa, synthetic construct
RSSQSLAKSYGNTYLS

SEQ ID NO: 972 - protein, 16 aa, synthetic construct
RSSQSLAKSYGNTYLS

SEQ ID NO: 973 - protein, 16 aa, synthetic construct
RSSQSLAKSYGNTYLS

SEQ ID NO: 974 - protein, 16 aa, synthetic construct
RSSQSLAKSYGNTYLS

SEQ ID NO: 975 - protein, 16 aa, synthetic construct
RSSQSLAKSYGNTYLS

SEQ ID NO: 976 - protein, 16 aa, synthetic construct
RSSQSLAKSYGNTYLS

SEQ ID NO: 977 - protein, 16 aa, synthetic construct
RSSQSLAKSYGNTYLS

SEQ ID NO: 978 - protein, 16 aa, synthetic construct
RSSQSLAKSYGNTYLS

SEQ ID NO: 979 - protein, 16 aa, synthetic construct
RSSQSLAKSYGNTYLS

SEQ ID NO: 980 - protein, 16 aa, synthetic construct
RSSQSLAKSYGNTYLS

SEQ ID NO: 981 - protein, 16 aa, synthetic construct
RSSQSLAKSYGNTYLS

SEQ ID NO: 982 - protein, 16 aa, synthetic construct
RSSQSLAKSYGNTYLS

SEQ ID NO: 983 - protein, 16 aa, synthetic construct
RSSQSLAKSYGNTYLS

SEQ ID NO: 984 - protein, 16 aa, synthetic construct
RSSQSLAKSYGNTYLS

SEQ ID NO: 985 - protein, 16 aa, synthetic construct
RSSQSLAKSYGNTYLS

SEQ ID NO: 986 - protein, 16 aa, synthetic construct
RSSQSLAKSYGNTYLS

SEQ ID NO: 987 - protein, 16 aa, synthetic construct
RSSQSLAKSYGNTYLS

SEQ ID NO: 988 - protein, 16 aa, synthetic construct
RSSQSLAKSYGNTYLS

SEQ ID NO: 989 - protein, 16 aa, synthetic construct
RSSQSLAKSYGNTYLS

SEQ ID NO: 990 - protein, 16 aa, synthetic construct
RSSQSLAKSYGNTYLS

SEQ ID NO: 991 - protein, 16 aa, synthetic construct
RSSQSLAKSYGNTYLS

SEQ ID NO: 992 - protein, 16 aa, synthetic construct
RSSQSLAKSYGNTYLS

SEQ ID NO: 993 - protein, 16 aa, synthetic construct
RSSQSLAKSYGNTYLS

SEQ ID NO: 994 - protein, 16 aa, synthetic construct
RSSQSLAKSYGNTYLS

SEQ ID NO: 995 - protein, 16 aa, synthetic construct
RSSQSLAKSYGNTYLS

SEQ ID NO: 996 - protein, 16 aa, synthetic construct
RSSQSLAKSYGNTYLS

SEQ ID NO: 997 - protein, 16 aa, synthetic construct
RSSQSLAKSYGNTYLS

SEQ ID NO: 998 - protein, 16 aa, synthetic construct
RSSQSLAKSYGNTYLS

SEQ ID NO: 999 - protein, 16 aa, synthetic construct
RSSQSLAKSYGNTYLS

SEQ ID NO: 1000 - protein, 16 aa, synthetic construct
RSSQSLAKSYGNTYLS

SEQ ID NO: 1001 - protein, 16 aa, synthetic construct
RSSQSLAKSYGNTYLS

SEQ ID NO: 1002 - protein, 16 aa, synthetic construct
RSSQSLAKSYGNTYLS

SEQ ID NO: 1003 - protein, 16 aa, synthetic construct
RSSQSLAASYGNTYLS

SEQ ID NO: 1004 - protein, 16 aa, synthetic construct
RSSQSLADSYGNTYLS

SEQ ID NO: 1005 - protein, 16 aa, synthetic construct
RSSQSLAISYGNTYLS

SEQ ID NO: 1006 - protein, 16 aa, synthetic construct
RSSQSLAIFYGNTYLS

SEQ ID NO: 1007 - protein, 16 aa, synthetic construct
RSSQSLAIFYGITYLS

SEQ ID NO: 1008 - protein, 16 aa, synthetic construct
RSSQSLAIFYGLTYLS

SEQ ID NO: 1009 - protein, 16 aa, synthetic construct
RSSQSLAILYGITYLS

SEQ ID NO: 1010 - protein, 16 aa, synthetic construct
RSSQSLAILYGLTYLS

SEQ ID NO: 1011 - protein, 16 aa, synthetic construct
RSSQSLALSYGNTYLS

SEQ ID NO: 1012 - protein, 16 aa, synthetic construct
RSSQSLAMSYGNTYLS

SEQ ID NO: 1013 - protein, 16 aa, synthetic construct
RSSQSLANSYGNTYLS

SEQ ID NO: 1014 - protein, 16 aa, synthetic construct
RSSQSLAPSYGNTYLS

SEQ ID NO: 1015 - protein, 16 aa, synthetic construct
RSSQSLAQSYGNTYLS

SEQ ID NO: 1016 - protein, 16 aa, synthetic construct
RSSQSLARSYGNTYLS

SEQ ID NO: 1017 - protein, 16 aa, synthetic construct
RSSQSLARFYGLTYLS

SEQ ID NO: 1018 - protein, 16 aa, synthetic construct
RSSQSLASSYGNTYLS

SEQ ID NO: 1019 - protein, 16 aa, synthetic construct
RSSQSLATSYGNTYLS

SEQ ID NO: 1020 - protein, 16 aa, synthetic construct
RSSQSLATYYGITYLS

SEQ ID NO: 1021 - protein, 16 aa, synthetic construct
RSSQSLATYYGLTYLS

SEQ ID NO: 1022 - protein, 16 aa, synthetic construct
RSSQSLAVSYGNTYLS

SEQ ID NO: 1023 - protein, 16 aa, synthetic construct
RSSQSLAYSYGNTYLS

SEQ ID NO: 1024 - protein, 16 aa, synthetic construct
RSSQSLAYFYGITYLS

SEQ ID NO: 1025 - protein, 16 aa, synthetic construct
RSSQSLAYLYGITYLS

SEQ ID NO: 1026 - protein, 16 aa, synthetic construct
RSSQSLAKSYGITYLS

SEQ ID NO: 1027 - protein, 16 aa, synthetic construct
RSSQSLAKSYGLTYLS

SEQ ID NO: 1028 - protein, 16 aa, synthetic construct
RSSQSLAKFYGNTYLS

SEQ ID NO: 1029 - protein, 16 aa, synthetic construct
RSSQSLAKIYGNTYLS

SEQ ID NO: 1030 - protein, 16 aa, synthetic construct
RSSQSLAKLYGNTYLS

SEQ ID NO: 1031 - protein, 16 aa, synthetic construct
RSSQSLAKMYGNTYLS

SEQ ID NO: 1032 - protein, 16 aa, synthetic construct
RSSQSLAKQYGNTYLS

SEQ ID NO: 1033 - protein, 16 aa, synthetic construct
RSSQSLAKYYGNTYLS

SEQ ID NO: 1034 - protein, 16 aa, synthetic construct
RSSQSLAKSHGNTYLS

SEQ ID NO: 1035 - protein, 16 aa, synthetic construct
RSSQSLAKSYGNTYLS

SEQ ID NO: 1036 - protein, 16 aa, synthetic construct
RSSQSLAKSYGNTYLS

SEQ ID NO: 1037 - protein, 16 aa, synthetic construct
RSSQSLAKSYGNTYLS

SEQ ID NO: 1038 - protein, 16 aa, synthetic construct
RSSQSLAKSYGNTYLS

SEQ ID NO: 1039 - protein, 16 aa, synthetic construct
RSSQSLAKSYGNTYLS

SEQ ID NO: 1040 - protein, 16 aa, synthetic construct
RSSQSLAKSYGNTYLS

SEQ ID NO: 1041 - protein, 16 aa, synthetic construct
RSSQSLAKSYGNTYLS

SEQ ID NO: 1042 - protein, 16 aa, synthetic construct
RSSQSLAKSYGNTYLS

SEQ ID NO: 1043 - protein, 16 aa, synthetic construct
RSSQSLAKSYGNTYLS

SEQ ID NO: 1044 - protein, 16 aa, synthetic construct
RSSQSLAKSYGNTYLS

SEQ ID NO: 1045 - protein, 16 aa, synthetic construct
RSSQSLAKSYGNTYLS

SEQ ID NO: 1046 - protein, 16 aa, synthetic construct
RSSQSLAKSYGNTYLS

SEQ ID NO: 1047 - protein, 16 aa, synthetic construct
RSSQSLAKSYGNTYLS

SEQ ID NO: 1048 - protein, 16 aa, synthetic construct
RSSQSLAKSYGNTYLS

SEQ ID NO: 1049 - protein, 16 aa, synthetic construct
RSSQSLAKSYGNTYLS

SEQ ID NO: 1050 - protein, 16 aa, synthetic construct
RSSQSLAKSYGNTYLS

SEQ ID NO: 1051 - protein, 16 aa, synthetic construct
RSSQSLAKSYGNTYLS

SEQ ID NO: 1052 - protein, 16 aa, synthetic construct
RSSQSLAKSYGNTYLS

SEQ ID NO: 1053 - protein, 16 aa, synthetic construct
RSSQSLAKSYGNTYLS

SEQ ID NO: 1054 - protein, 16 aa, synthetic construct
RSSQSLAKSYGNTYLS

SEQ ID NO: 1055 - protein, 16 aa, synthetic construct
RSSQSLAKSYGNTYLS

SEQ ID NO: 1056 - protein, 16 aa, synthetic construct
RSSQSLAKSYGNTYLS

SEQ ID NO: 1057 - protein, 16 aa, synthetic construct
RSSQSLAKSYGNTYLS

SEQ ID NO: 1058 - protein, 16 aa, synthetic construct
RSSQSLAKSYGNTYLS

SEQ ID NO: 1059 - protein, 16 aa, synthetic construct
RSSQSLAKSYGNTYLS

SEQ ID NO: 1060 - protein, 16 aa, synthetic construct
RSSQSLAKSYGNTYLS

SEQ ID NO: 1061 - protein, 7 aa, synthetic construct
GISNRFS

SEQ ID NO: 1062 - protein, 7 aa, synthetic construct
GISNRFS

SEQ ID NO: 1063 - protein, 7 aa, synthetic construct
GISNRFS

SEQ ID NO: 1064 - protein, 7 aa, synthetic construct
GISNRFS

SEQ ID NO: 1065 - protein, 7 aa, synthetic construct
GISNRFS

SEQ ID NO: 1066 - protein, 7 aa, synthetic construct
GISNRFS

SEQ ID NO: 1067 - protein, 7 aa, synthetic construct
GISNRFS

SEQ ID NO: 1068 - protein, 7 aa, synthetic construct
GISNRFS

SEQ ID NO: 1069 - protein, 7 aa, synthetic construct
GISNRFS

SEQ ID NO: 1070 - protein, 7 aa, synthetic construct
GISNRFS

SEQ ID NO: 1071 - protein, 7 aa, synthetic construct
GISNRFS

SEQ ID NO: 1072 - protein, 7 aa, synthetic construct
GISNRFS

SEQ ID NO: 1073 - protein, 7 aa, synthetic construct
GISNRFS

SEQ ID NO: 1074 - protein, 7 aa, synthetic construct
GISNRFS

SEQ ID NO: 1075 - protein, 7 aa, synthetic construct
GISNRFS

SEQ ID NO: 1076 - protein, 7 aa, synthetic construct
GISNRFS

SEQ ID NO: 1077 - protein, 7 aa, synthetic construct
GISNRFS

SEQ ID NO: 1078 - protein, 7 aa, synthetic construct
GISNRFS

SEQ ID NO: 1079 - protein, 7 aa, synthetic construct
GISNRFS

SEQ ID NO: 1080 - protein, 7 aa, synthetic construct
GISNRFS

SEQ ID NO: 1081 - protein, 7 aa, synthetic construct
GISNRFS

SEQ ID NO: 1082 - protein, 7 aa, synthetic construct
GISNRFS

SEQ ID NO: 1083 - protein, 7 aa, synthetic construct
GISNRFS

SEQ ID NO: 1084 - protein, 7 aa, synthetic construct
GISNRFS

SEQ ID NO: 1085 - protein, 7 aa, synthetic construct
GISNRFS

SEQ ID NO: 1086 - protein, 7 aa, synthetic construct
GISNRFS

SEQ ID NO: 1087 - protein, 7 aa, synthetic construct
GISNRFS

SEQ ID NO: 1088 - protein, 7 aa, synthetic construct
GISNRFS

SEQ ID NO: 1089 - protein, 7 aa, synthetic construct
GISNRFS

SEQ ID NO: 1090 - protein, 7 aa, synthetic construct
GISNRFS

SEQ ID NO: 1091 - protein, 7 aa, synthetic construct
GISNRFS

SEQ ID NO: 1092 - protein, 7 aa, synthetic construct
GISNRFS

SEQ ID NO: 1093 - protein, 7 aa, synthetic construct
GISNRFS

SEQ ID NO: 1094 - protein, 7 aa, synthetic construct
GISNRFS

SEQ ID NO: 1095 - protein, 7 aa, synthetic construct
GISNRFS

SEQ ID NO: 1096 - protein, 7 aa, synthetic construct
GISNRFS

SEQ ID NO: 1097 - protein, 7 aa, synthetic construct
GISNRFS

SEQ ID NO: 1098 - protein, 7 aa, synthetic construct
GISNRFS

SEQ ID NO: 1099 - protein, 7 aa, synthetic construct
GISNRFS

SEQ ID NO: 1100 - protein, 7 aa, synthetic construct
GISNRFS

SEQ ID NO: 1101 - protein, 7 aa, synthetic construct
GISNRFS

SEQ ID NO: 1102 - protein, 7 aa, synthetic construct
GISNRFS

SEQ ID NO: 1103 - protein, 7 aa, synthetic construct
GISNRFS

SEQ ID NO: 1104 - protein, 7 aa, synthetic construct
GISNRFS

SEQ ID NO: 1105 - protein, 7 aa, synthetic construct
GISNRFS

SEQ ID NO: 1106 - protein, 7 aa, synthetic construct
GISNRFS

SEQ ID NO: 1107 - protein, 7 aa, synthetic construct
GISNRFS

SEQ ID NO: 1108 - protein, 7 aa, synthetic construct
GISNRFS

SEQ ID NO: 1109 - protein, 7 aa, synthetic construct
GISNRFS

SEQ ID NO: 1110 - protein, 7 aa, synthetic construct
GISNRFS

SEQ ID NO: 1111 - protein, 7 aa, synthetic construct
GISNRFS

SEQ ID NO: 1112 - protein, 7 aa, synthetic construct
GISNRFS

SEQ ID NO: 1113 - protein, 7 aa, synthetic construct
GISNRFS

SEQ ID NO: 1114 - protein, 7 aa, synthetic construct
GISNRFS

SEQ ID NO: 1115 - protein, 7 aa, synthetic construct
GISNRFS

SEQ ID NO: 1116 - protein, 7 aa, synthetic construct
GISNRFS

SEQ ID NO: 1117 - protein, 7 aa, synthetic construct
GISNRFS

SEQ ID NO: 1118 - protein, 7 aa, synthetic construct
GISNRFS

SEQ ID NO: 1119 - protein, 7 aa, synthetic construct
GISNRFS

SEQ ID NO: 1120 - protein, 7 aa, synthetic construct
GISNRFS

SEQ ID NO: 1121 - protein, 7 aa, synthetic construct
GISNRFS

SEQ ID NO: 1122 - protein, 7 aa, synthetic construct
GISNRFS

SEQ ID NO: 1123 - protein, 7 aa, synthetic construct
GISNRFS

SEQ ID NO: 1124 - protein, 7 aa, synthetic construct
GISNRFS

SEQ ID NO: 1125 - protein, 7 aa, synthetic construct
GISNRFS

SEQ ID NO: 1126 - protein, 7 aa, synthetic construct
GISNRFS

SEQ ID NO: 1127 - protein, 7 aa, synthetic construct
GISNRFS

SEQ ID NO: 1128 - protein, 7 aa, synthetic construct
GISNRFS

SEQ ID NO: 1129 - protein, 7 aa, synthetic construct
GISNRFS

SEQ ID NO: 1130 - protein, 7 aa, synthetic construct
GISNRFS

SEQ ID NO: 1131 - protein, 7 aa, synthetic construct
GISNRFS

SEQ ID NO: 1132 - protein, 7 aa, synthetic construct
GISNRFS

SEQ ID NO: 1133 - protein, 7 aa, synthetic construct
GISNRFS

SEQ ID NO: 1134 - protein, 7 aa, synthetic construct
GISNRFS

SEQ ID NO: 1135 - protein, 7 aa, synthetic construct
GISNRFS

SEQ ID NO: 1136 - protein, 7 aa, synthetic construct
GISNRFS

SEQ ID NO: 1137 - protein, 7 aa, synthetic construct
GISNRFS

SEQ ID NO: 1138 - protein, 7 aa, synthetic construct
GISNRFS

SEQ ID NO: 1139 - protein, 7 aa, synthetic construct
GISNRFS

SEQ ID NO: 1140 - protein, 7 aa, synthetic construct
GISNRFS

SEQ ID NO: 1141 - protein, 7 aa, synthetic construct
FISNRFS

SEQ ID NO: 1142 - protein, 7 aa, synthetic construct
PISNRFS

SEQ ID NO: 1143 - protein, 7 aa, synthetic construct
YISNRFS

SEQ ID NO: 1144 - protein, 7 aa, synthetic construct
GISNRFS

SEQ ID NO: 1145 - protein, 7 aa, synthetic construct
GISNRFS

SEQ ID NO: 1146 - protein, 7 aa, synthetic construct
GISNRFS

SEQ ID NO: 1147 - protein, 7 aa, synthetic construct
GISNRFS

SEQ ID NO: 1148 - protein, 7 aa, synthetic construct
GISNRFS

SEQ ID NO: 1149 - protein, 7 aa, synthetic construct
GISNRFS

SEQ ID NO: 1150 - protein, 7 aa, synthetic construct
GISNRFS

SEQ ID NO: 1151 - protein, 7 aa, synthetic construct
GISNRFS

SEQ ID NO: 1152 - protein, 7 aa, synthetic construct
GISNRFS

SEQ ID NO: 1153 - protein, 7 aa, synthetic construct
GISNRFS

SEQ ID NO: 1154 - protein, 7 aa, synthetic construct
GISNRFS

SEQ ID NO: 1155 - protein, 7 aa, synthetic construct
GISNRFS

SEQ ID NO: 1156 - protein, 7 aa, synthetic construct
GISNRFS

SEQ ID NO: 1157 - protein, 7 aa, synthetic construct
GISNRFS

SEQ ID NO: 1158 - protein, 7 aa, synthetic construct
GISNRFS

SEQ ID NO: 1159 - protein, 7 aa, synthetic construct
GISNRFS

SEQ ID NO: 1160 - protein, 7 aa, synthetic construct
GISNRFS

SEQ ID NO: 1161 - protein, 7 aa, synthetic construct
GISNRFS

SEQ ID NO: 1162 - protein, 7 aa, synthetic construct
GISNRFS

SEQ ID NO: 1163 - protein, 7 aa, synthetic construct
GISNRFS

SEQ ID NO: 1164 - protein, 7 aa, synthetic construct
GISNRFS

SEQ ID NO: 1165 - protein, 7 aa, synthetic construct
GISNRFS

SEQ ID NO: 1166 - protein, 7 aa, synthetic construct
GISNRFS

SEQ ID NO: 1167 - protein, 9 aa, synthetic construct
LQGTHQPYT

SEQ ID NO: 1168 - protein, 9 aa, synthetic construct
LQGTHQPYT

SEQ ID NO: 1169 - protein, 9 aa, synthetic construct
LQGTHQPYT

SEQ ID NO: 1170 - protein, 9 aa, synthetic construct
LQGTHQPYT

SEQ ID NO: 1171 - protein, 9 aa, synthetic construct
LQGTHQPYT

SEQ ID NO: 1172 - protein, 9 aa, synthetic construct
LQGTHQPYT

SEQ ID NO: 1173 - protein, 9 aa, synthetic construct
LQGTHQPYT

SEQ ID NO: 1174 - protein, 9 aa, synthetic construct
LQGTHQPYT

SEQ ID NO: 1175 - protein, 9 aa, synthetic construct
LQGTHQPYT

SEQ ID NO: 1176 - protein, 9 aa, synthetic construct
LQGTHQPYT

SEQ ID NO: 1177 - protein, 9 aa, synthetic construct
LQGTHQPYT

SEQ ID NO: 1178 - protein, 9 aa, synthetic construct
LQGTHQPYT

SEQ ID NO: 1179 - protein, 9 aa, synthetic construct
LQGTHQPYT

SEQ ID NO: 1180 - protein, 9 aa, synthetic construct
LQGTHQPYT

SEQ ID NO: 1181 - protein, 9 aa, synthetic construct
LQGTHQPYT

SEQ ID NO: 1182 - protein, 9 aa, synthetic construct
LQGTHQPYT

SEQ ID NO: 1183 - protein, 9 aa, synthetic construct
LQGTHQPYT

SEQ ID NO: 1184 - protein, 9 aa, synthetic construct
LQGTHQPYT

SEQ ID NO: 1185 - protein, 9 aa, synthetic construct
LQGTHQPYT

SEQ ID NO: 1186 - protein, 9 aa, synthetic construct
LQGTHQPYT

SEQ ID NO: 1187 - protein, 9 aa, synthetic construct
LQGTHQPYT

SEQ ID NO: 1188 - protein, 9 aa, synthetic construct
LQGTHQPYT

SEQ ID NO: 1189 - protein, 9 aa, synthetic construct
LQGTHQPYT

SEQ ID NO: 1190 - protein, 9 aa, synthetic construct
LQGTHQPYT

SEQ ID NO: 1191 - protein, 9 aa, synthetic construct
LQGTHQPYT

SEQ ID NO: 1192 - protein, 9 aa, synthetic construct
LQGTHQPYT

SEQ ID NO: 1193 - protein, 9 aa, synthetic construct
LQGTHQPYT

SEQ ID NO: 1194 - protein, 9 aa, synthetic construct
LQGTHQPYT

SEQ ID NO: 1195 - protein, 9 aa, synthetic construct
LQGTHQPYT

SEQ ID NO: 1196 - protein, 9 aa, synthetic construct
LQGTHQPYT

SEQ ID NO: 1197 - protein, 9 aa, synthetic construct
LQGTHQPYT

SEQ ID NO: 1198 - protein, 9 aa, synthetic construct
LQGTHQPYT

SEQ ID NO: 1199 - protein, 9 aa, synthetic construct
LQGTHQPYT

SEQ ID NO: 1200 - protein, 9 aa, synthetic construct
LQGTHQPYT

SEQ ID NO: 1201 - protein, 9 aa, synthetic construct
LQGTHQPYT

SEQ ID NO: 1202 - protein, 9 aa, synthetic construct
LQGTHQPYT

SEQ ID NO: 1203 - protein, 9 aa, synthetic construct
LQGTHQPYT

SEQ ID NO: 1204 - protein, 9 aa, synthetic construct
LQGTHQPYT

SEQ ID NO: 1205 - protein, 9 aa, synthetic construct
LQGTHQPYT

SEQ ID NO: 1206 - protein, 9 aa, synthetic construct
LQGTHQPYT

SEQ ID NO: 1207 - protein, 9 aa, synthetic construct
LQGTHQPYT

SEQ ID NO: 1208 - protein, 9 aa, synthetic construct
LQGTHQPYT

SEQ ID NO: 1209 - protein, 9 aa, synthetic construct
LQGTHQPYT

SEQ ID NO: 1210 - protein, 9 aa, synthetic construct
LQGTHQPYT

SEQ ID NO: 1211 - protein, 9 aa, synthetic construct
LQGTHQPYT

SEQ ID NO: 1212 - protein, 9 aa, synthetic construct
LQGTHQPYT

SEQ ID NO: 1213 - protein, 9 aa, synthetic construct
LQGTHQPYT

SEQ ID NO: 1214 - protein, 9 aa, synthetic construct
LQGTHQPYT

SEQ ID NO: 1215 - protein, 9 aa, synthetic construct
LQGTHQPYT

SEQ ID NO: 1216 - protein, 9 aa, synthetic construct
LQGTHQPYT

SEQ ID NO: 1217 - protein, 9 aa, synthetic construct
LQGTHQPYT

SEQ ID NO: 1218 - protein, 9 aa, synthetic construct
LQGTHQPYT

SEQ ID NO: 1219 - protein, 9 aa, synthetic construct
LQGTHQPYT

SEQ ID NO: 1220 - protein, 9 aa, synthetic construct
LQGTHQPYT

SEQ ID NO: 1221 - protein, 9 aa, synthetic construct
LQGTHQPYT

SEQ ID NO: 1222 - protein, 9 aa, synthetic construct
LQGTHQPYT

SEQ ID NO: 1223 - protein, 9 aa, synthetic construct
LQGTHQPYT

SEQ ID NO: 1224 - protein, 9 aa, synthetic construct
LQGTHQPYT

SEQ ID NO: 1225 - protein, 9 aa, synthetic construct
LQGTHQPYT

SEQ ID NO: 1226 - protein, 9 aa, synthetic construct
LQGTHQPYT

SEQ ID NO: 1227 - protein, 9 aa, synthetic construct
LQGTHQPYT

SEQ ID NO: 1228 - protein, 9 aa, synthetic construct
LQGTHQPYT

SEQ ID NO: 1229 - protein, 9 aa, synthetic construct
LQGTHQPYT

SEQ ID NO: 1230 - protein, 9 aa, synthetic construct
LQGTHQPYT

SEQ ID NO: 1231 - protein, 9 aa, synthetic construct
LQGTHQPYT

SEQ ID NO: 1232 - protein, 9 aa, synthetic construct
LQGTHQPYT

SEQ ID NO: 1233 - protein, 9 aa, synthetic construct
LQGTHQPYT

SEQ ID NO: 1234 - protein, 9 aa, synthetic construct
LQGTHQPYT

SEQ ID NO: 1235 - protein, 9 aa, synthetic construct
LQGTHQPYT

SEQ ID NO: 1236 - protein, 9 aa, synthetic construct
LQGTHQPYT

SEQ ID NO: 1237 - protein, 9 aa, synthetic construct
LQGTHQPYT

SEQ ID NO: 1238 - protein, 9 aa, synthetic construct
LQGTHQPYT

SEQ ID NO: 1239 - protein, 9 aa, synthetic construct
LQGTHQPYT

SEQ ID NO: 1240 - protein, 9 aa, synthetic construct
LQGTHQPYT

SEQ ID NO: 1241 - protein, 9 aa, synthetic construct
LQGTHQPYT

SEQ ID NO: 1242 - protein, 9 aa, synthetic construct
LQGTHQPYT

SEQ ID NO: 1243 - protein, 9 aa, synthetic construct
LQGTHQPYT

SEQ ID NO: 1244 - protein, 9 aa, synthetic construct
LQGTHQPYT

SEQ ID NO: 1245 - protein, 9 aa, synthetic construct
LQGTHQPYT

SEQ ID NO: 1246 - protein, 9 aa, synthetic construct
LQGTHQPYT

SEQ ID NO: 1247 - protein, 9 aa, synthetic construct
LQGTHQPYT

SEQ ID NO: 1248 - protein, 9 aa, synthetic construct
LQGTHQPYT

SEQ ID NO: 1249 - protein, 9 aa, synthetic construct
LQGTHQPYT

SEQ ID NO: 1250 - protein, 9 aa, synthetic construct
LQFTHQPYT

SEQ ID NO: 1251 - protein, 9 aa, synthetic construct
LQFTIQFYT

SEQ ID NO: 1252 - protein, 9 aa, synthetic construct
LQFTIQVYT

SEQ ID NO: 1253 - protein, 9 aa, synthetic construct
LQFTIQPYI

SEQ ID NO: 1254 - protein, 9 aa, synthetic construct
LQFTHQFYT

SEQ ID NO: 1255 - protein, 9 aa, synthetic construct
LQFTHQIYI

SEQ ID NO: 1256 - protein, 9 aa, synthetic construct
LQFTHQPYI

SEQ ID NO: 1257 - protein, 9 aa, synthetic construct
LQRTHQPYT

SEQ ID NO: 1258 - protein, 9 aa, synthetic construct
LQRTIQVYI

SEQ ID NO: 1259 - protein, 9 aa, synthetic construct
LQRTIQYYT

SEQ ID NO: 1260 - protein, 9 aa, synthetic construct
LQVTHQPYT

SEQ ID NO: 1261 - protein, 9 aa, synthetic construct
LQWTHQPYT

SEQ ID NO: 1262 - protein, 9 aa, synthetic construct
LQYTHQPYT

SEQ ID NO: 1263 - protein, 9 aa, synthetic construct
LQYTIQFYI

SEQ ID NO: 1264 - protein, 9 aa, synthetic construct
LQYTHQFYI

SEQ ID NO: 1265 - protein, 9 aa, synthetic construct
LQGTIQPYT

SEQ ID NO: 1266 - protein, 9 aa, synthetic construct
LQGTWQPYT

SEQ ID NO: 1267 - protein, 9 aa, synthetic construct
LQGTHQFYT

SEQ ID NO: 1268 - protein, 9 aa, synthetic construct
LQGTHQIYT

SEQ ID NO: 1269 - protein, 9 aa, synthetic construct
LQGTHQVYT

SEQ ID NO: 1270 - protein, 9 aa, synthetic construct
LQGTHQYYT

SEQ ID NO: 1271 - protein, 9 aa, synthetic construct
LQGTHQPYI

SEQ ID NO: 1272 - protein, 9 aa, synthetic construct
LQGTHQPYR

SEQ ID NO: 1273 - protein, 8 aa, synthetic construct
GGTFTSYW

SEQ ID NO: 1274 - protein, 8 aa, synthetic construct
GYTFTSYW

SEQ ID NO: 1275 - protein, 8 aa, synthetic construct
GYTFTIYW

SEQ ID NO: 1276 - protein, 8 aa, synthetic construct
GYTFTVYW

SEQ ID NO: 1277 - protein, 8 aa, synthetic construct
GYTFTSMW

SEQ ID NO: 1278 - protein, 8 aa, synthetic construct
GYTFTSQW

SEQ ID NO: 1279 - protein, 8 aa, synthetic construct
GYTFTSYW

SEQ ID NO: 1280 - protein, 8 aa, synthetic construct
GYTFTSYW

SEQ ID NO: 1281 - protein, 8 aa, synthetic construct
GYTFTSYW

SEQ ID NO: 1282 - protein, 8 aa, synthetic construct
GYTFTSYW

SEQ ID NO: 1283 - protein, 8 aa, synthetic construct
GYTFTSYW

SEQ ID NO: 1284 - protein, 8 aa, synthetic construct
GYTFTSYW

SEQ ID NO: 1285 - protein, 8 aa, synthetic construct
GYTFTSYW

SEQ ID NO: 1286 - protein, 8 aa, synthetic construct
GYTFTSYW

SEQ ID NO: 1287 - protein, 8 aa, synthetic construct
GYTFTSYW

SEQ ID NO: 1288 - protein, 8 aa, synthetic construct
GYTFTSYW

SEQ ID NO: 1289 - protein, 8 aa, synthetic construct
GYTFTSYW

SEQ ID NO: 1290 - protein, 8 aa, synthetic construct
GYTFTSYW

SEQ ID NO: 1291 - protein, 8 aa, synthetic construct
GYTFTSYW

SEQ ID NO: 1292 - protein, 8 aa, synthetic construct
GYTFTSYW

SEQ ID NO: 1293 - protein, 8 aa, synthetic construct
GYTFTSYW

SEQ ID NO: 1294 - protein, 8 aa, synthetic construct
GYTFTSYW

SEQ ID NO: 1295 - protein, 8 aa, synthetic construct
GYTFTSYW

SEQ ID NO: 1296 - protein, 8 aa, synthetic construct
GYTFTSYW

SEQ ID NO: 1297 - protein, 8 aa, synthetic construct
GYTFTSYW

SEQ ID NO: 1298 - protein, 8 aa, synthetic construct
GYTFTSYW

SEQ ID NO: 1299 - protein, 8 aa, synthetic construct
GYTFTSYW

SEQ ID NO: 1300 - protein, 8 aa, synthetic construct
GYTFTSYW

SEQ ID NO: 1301 - protein, 8 aa, synthetic construct
GYTFTSYW

SEQ ID NO: 1302 - protein, 8 aa, synthetic construct
GYTFTSYW

SEQ ID NO: 1303 - protein, 8 aa, synthetic construct
GYTFTSYW

SEQ ID NO: 1304 - protein, 8 aa, synthetic construct
GYTFTSYW

SEQ ID NO: 1305 - protein, 8 aa, synthetic construct
GYTFTSYW

SEQ ID NO: 1306 - protein, 8 aa, synthetic construct
GYTFTSYW

SEQ ID NO: 1307 - protein, 8 aa, synthetic construct
GYTFTSYW

SEQ ID NO: 1308 - protein, 8 aa, synthetic construct
GYTFTSYW

SEQ ID NO: 1309 - protein, 8 aa, synthetic construct
GYTFTSYW

SEQ ID NO: 1310 - protein, 8 aa, synthetic construct
GYTFTSYW

SEQ ID NO: 1311 - protein, 8 aa, synthetic construct
GYTFTSYW

SEQ ID NO: 1312 - protein, 8 aa, synthetic construct
GYTFTSYW

SEQ ID NO: 1313 - protein, 8 aa, synthetic construct
GYTFTSYW

SEQ ID NO: 1314 - protein, 8 aa, synthetic construct
GYTFTSYW

SEQ ID NO: 1315 - protein, 8 aa, synthetic construct
GYTFTSYW

SEQ ID NO: 1316 - protein, 8 aa, synthetic construct
GYTFTSYW

SEQ ID NO: 1317 - protein, 8 aa, synthetic construct
GYTFTSYW

SEQ ID NO: 1318 - protein, 8 aa, synthetic construct
GYTFTSYW

SEQ ID NO: 1319 - protein, 8 aa, synthetic construct
GYTFTSYW

SEQ ID NO: 1320 - protein, 8 aa, synthetic construct
GYTFTSYW

SEQ ID NO: 1321 - protein, 8 aa, synthetic construct
GYTFTSYW

SEQ ID NO: 1322 - protein, 8 aa, synthetic construct
GYTFTSYW

SEQ ID NO: 1323 - protein, 8 aa, synthetic construct
GYTFTSYW

SEQ ID NO: 1324 - protein, 8 aa, synthetic construct
GYTFTSYW

SEQ ID NO: 1325 - protein, 8 aa, synthetic construct
GYTFTSYW

SEQ ID NO: 1326 - protein, 8 aa, synthetic construct
GYTFTSYW

SEQ ID NO: 1327 - protein, 8 aa, synthetic construct
GYTFTSYW

SEQ ID NO: 1328 - protein, 8 aa, synthetic construct
GYTFTSYW

SEQ ID NO: 1329 - protein, 8 aa, synthetic construct
GYTFTSYW

SEQ ID NO: 1330 - protein, 8 aa, synthetic construct
GYTFTSYW

SEQ ID NO: 1331 - protein, 8 aa, synthetic construct
GYTFTSYW

SEQ ID NO: 1332 - protein, 8 aa, synthetic construct
GYTFTSYW

SEQ ID NO: 1333 - protein, 8 aa, synthetic construct
GYTFTSYW

SEQ ID NO: 1334 - protein, 8 aa, synthetic construct
GYTFTSYW

SEQ ID NO: 1335 - protein, 8 aa, synthetic construct
GYTFTSYW

SEQ ID NO: 1336 - protein, 8 aa, synthetic construct
GYTFTSYW

SEQ ID NO: 1337 - protein, 8 aa, synthetic construct
GYTFTSYW

SEQ ID NO: 1338 - protein, 8 aa, synthetic construct
GYTFTSYW

SEQ ID NO: 1339 - protein, 8 aa, synthetic construct
GYTFTSYW

SEQ ID NO: 1340 - protein, 8 aa, synthetic construct
GYTFTSYW

SEQ ID NO: 1341 - protein, 8 aa, synthetic construct
GYTFTSYW

SEQ ID NO: 1342 - protein, 8 aa, synthetic construct
GYTFTSYW

SEQ ID NO: 1343 - protein, 8 aa, synthetic construct
GYTFTSYW

SEQ ID NO: 1344 - protein, 8 aa, synthetic construct
GYTFTSYW

SEQ ID NO: 1345 - protein, 8 aa, synthetic construct
GYTFTSYW

SEQ ID NO: 1346 - protein, 8 aa, synthetic construct
GYTFTSYW

SEQ ID NO: 1347 - protein, 8 aa, synthetic construct
GYTFTSYW

SEQ ID NO: 1348 - protein, 8 aa, synthetic construct
GYTFTSYW

SEQ ID NO: 1349 - protein, 8 aa, synthetic construct
GYTFTSYW

SEQ ID NO: 1350 - protein, 8 aa, synthetic construct
GYTFTSYW

SEQ ID NO: 1351 - protein, 8 aa, synthetic construct
GYTFTSYW

SEQ ID NO: 1352 - protein, 8 aa, synthetic construct
GYTFTSYW

SEQ ID NO: 1353 - protein, 8 aa, synthetic construct
GYTFTSYW

SEQ ID NO: 1354 - protein, 8 aa, synthetic construct
GYTFTSYW

SEQ ID NO: 1355 - protein, 8 aa, synthetic construct
GYTFTSYW

SEQ ID NO: 1356 - protein, 8 aa, synthetic construct
GYTFTSYW

SEQ ID NO: 1357 - protein, 8 aa, synthetic construct
GYTFTSYW

SEQ ID NO: 1358 - protein, 8 aa, synthetic construct
GYTFTSYW

SEQ ID NO: 1359 - protein, 8 aa, synthetic construct
GYTFTSYW

SEQ ID NO: 1360 - protein, 8 aa, synthetic construct
GYTFTSYW

SEQ ID NO: 1361 - protein, 8 aa, synthetic construct
GYTFTSYW

SEQ ID NO: 1362 - protein, 8 aa, synthetic construct
GYTFTSYW

SEQ ID NO: 1363 - protein, 8 aa, synthetic construct
GYTFTSYW

SEQ ID NO: 1364 - protein, 8 aa, synthetic construct
GYTFTSYW

SEQ ID NO: 1365 - protein, 8 aa, synthetic construct
GYTFTSYW

SEQ ID NO: 1366 - protein, 8 aa, synthetic construct
GYTFTSYW

SEQ ID NO: 1367 - protein, 8 aa, synthetic construct
GYTFTSYW

SEQ ID NO: 1368 - protein, 8 aa, synthetic construct
GYTFTSYW

SEQ ID NO: 1369 - protein, 8 aa, synthetic construct
GYTFTSYW

SEQ ID NO: 1370 - protein, 8 aa, synthetic construct
GYTFTSYW

SEQ ID NO: 1371 - protein, 8 aa, synthetic construct
GYTFTSYW

SEQ ID NO: 1372 - protein, 8 aa, synthetic construct
GYTFTSYW

SEQ ID NO: 1373 - protein, 8 aa, synthetic construct
GYTFTSYW

SEQ ID NO: 1374 - protein, 8 aa, synthetic construct
GYTFTSYW

SEQ ID NO: 1375 - protein, 8 aa, synthetic construct
GYTFTSYW

SEQ ID NO: 1376 - protein, 8 aa, synthetic construct
GYTFTSYW

SEQ ID NO: 1377 - protein, 8 aa, synthetic construct
GYTFTSYW

SEQ ID NO: 1378 - protein, 8 aa, synthetic construct
GYTFTSYW

SEQ ID NO: 1379 - protein, 8 aa, synthetic construct
IDPSESNT

SEQ ID NO: 1380 - protein, 8 aa, synthetic construct
IDPSESNT

SEQ ID NO: 1381 - protein, 8 aa, synthetic construct
IDPSESNT

SEQ ID NO: 1382 - protein, 8 aa, synthetic construct
IDPSESNT

SEQ ID NO: 1383 - protein, 8 aa, synthetic construct
IDPSESNT

SEQ ID NO: 1384 - protein, 8 aa, synthetic construct
IDPSESNT

SEQ ID NO: 1385 - protein, 8 aa, synthetic construct
IIPSESNT

SEQ ID NO: 1386 - protein, 8 aa, synthetic construct
IIPLESNT

SEQ ID NO: 1387 - protein, 8 aa, synthetic construct
IIPRESNT

SEQ ID NO: 1388 - protein, 8 aa, synthetic construct
IIPVESNT

SEQ ID NO: 1389 - protein, 8 aa, synthetic construct
IRPSESNT

SEQ ID NO: 1390 - protein, 8 aa, synthetic construct
IRPLESNT

SEQ ID NO: 1391 - protein, 8 aa, synthetic construct
IRPRESNT

SEQ ID NO: 1392 - protein, 8 aa, synthetic construct
IRPVESNT

SEQ ID NO: 1393 - protein, 8 aa, synthetic construct
IDPLESNT

SEQ ID NO: 1394 - protein, 8 aa, synthetic construct
IDPMESNT

SEQ ID NO: 1395 - protein, 8 aa, synthetic construct
IDPRESNT

SEQ ID NO: 1396 - protein, 8 aa, synthetic construct
IDPVESNT

SEQ ID NO: 1397 - protein, 8 aa, synthetic construct
IDPSESNT

SEQ ID NO: 1398 - protein, 8 aa, synthetic construct
IDPSESNT

SEQ ID NO: 1399 - protein, 8 aa, synthetic construct
IDPSESNT

SEQ ID NO: 1400 - protein, 8 aa, synthetic construct
IDPSESNT

SEQ ID NO: 1401 - protein, 8 aa, synthetic construct
IDPSESNT

SEQ ID NO: 1402 - protein, 8 aa, synthetic construct
IDPSESNT

SEQ ID NO: 1403 - protein, 8 aa, synthetic construct
IDPSESNT

SEQ ID NO: 1404 - protein, 8 aa, synthetic construct
IDPSESNT

SEQ ID NO: 1405 - protein, 8 aa, synthetic construct
IDPSESNT

SEQ ID NO: 1406 - protein, 8 aa, synthetic construct
IDPSESNT

SEQ ID NO: 1407 - protein, 8 aa, synthetic construct
IDPSESNT

SEQ ID NO: 1408 - protein, 8 aa, synthetic construct
IDPSESNT

SEQ ID NO: 1409 - protein, 8 aa, synthetic construct
IDPSESNT

SEQ ID NO: 1410 - protein, 8 aa, synthetic construct
IDPSESNT

SEQ ID NO: 1411 - protein, 8 aa, synthetic construct
IDPSESNT

SEQ ID NO: 1412 - protein, 8 aa, synthetic construct
IDPSESNT

SEQ ID NO: 1413 - protein, 8 aa, synthetic construct
IDPSESNT

SEQ ID NO: 1414 - protein, 8 aa, synthetic construct
IDPSESNT

SEQ ID NO: 1415 - protein, 8 aa, synthetic construct
IDPSESNT

SEQ ID NO: 1416 - protein, 8 aa, synthetic construct
IDPSESNT

SEQ ID NO: 1417 - protein, 8 aa, synthetic construct
IDPSESNT

SEQ ID NO: 1418 - protein, 8 aa, synthetic construct
IDPSESNT

SEQ ID NO: 1419 - protein, 8 aa, synthetic construct
IDPSESNT

SEQ ID NO: 1420 - protein, 8 aa, synthetic construct
IDPSESNT

SEQ ID NO: 1421 - protein, 8 aa, synthetic construct
IDPSESNT

SEQ ID NO: 1422 - protein, 8 aa, synthetic construct
IDPSESNT

SEQ ID NO: 1423 - protein, 8 aa, synthetic construct
IDPSESNT

SEQ ID NO: 1424 - protein, 8 aa, synthetic construct
IDPSESNT

SEQ ID NO: 1425 - protein, 8 aa, synthetic construct
IDPSESNT

SEQ ID NO: 1426 - protein, 8 aa, synthetic construct
IDPSESNT

SEQ ID NO: 1427 - protein, 8 aa, synthetic construct
IDPSESNT

SEQ ID NO: 1428 - protein, 8 aa, synthetic construct
IDPSESNT

SEQ ID NO: 1429 - protein, 8 aa, synthetic construct
IDPSESNT

SEQ ID NO: 1430 - protein, 8 aa, synthetic construct
IDPSESNT

SEQ ID NO: 1431 - protein, 8 aa, synthetic construct
IDPSESNT

SEQ ID NO: 1432 - protein, 8 aa, synthetic construct
IDPSESNT

SEQ ID NO: 1433 - protein, 8 aa, synthetic construct
IDPSESNT

SEQ ID NO: 1434 - protein, 8 aa, synthetic construct
IDPSESNT

SEQ ID NO: 1435 - protein, 8 aa, synthetic construct
IDPSESNT

SEQ ID NO: 1436 - protein, 8 aa, synthetic construct
IDPSESNT

SEQ ID NO: 1437 - protein, 8 aa, synthetic construct
IDPSESNT

SEQ ID NO: 1438 - protein, 8 aa, synthetic construct
IDPSESNT

SEQ ID NO: 1439 - protein, 8 aa, synthetic construct
IDPSESNT

SEQ ID NO: 1440 - protein, 8 aa, synthetic construct
IDPSESNT

SEQ ID NO: 1441 - protein, 8 aa, synthetic construct
IDPSESNT

SEQ ID NO: 1442 - protein, 8 aa, synthetic construct
IDPSESNT

SEQ ID NO: 1443 - protein, 8 aa, synthetic construct
IDPSESNT

SEQ ID NO: 1444 - protein, 8 aa, synthetic construct
IDPSESNT

SEQ ID NO: 1445 - protein, 8 aa, synthetic construct
IDPSESNT

SEQ ID NO: 1446 - protein, 8 aa, synthetic construct
IDPSESNT

SEQ ID NO: 1447 - protein, 8 aa, synthetic construct
IDPSESNT

SEQ ID NO: 1448 - protein, 8 aa, synthetic construct
IDPSESNT

SEQ ID NO: 1449 - protein, 8 aa, synthetic construct
IDPSESNT

SEQ ID NO: 1450 - protein, 8 aa, synthetic construct
IDPSESNT

SEQ ID NO: 1451 - protein, 8 aa, synthetic construct
IDPSESNT

SEQ ID NO: 1452 - protein, 8 aa, synthetic construct
IDPSESNT

SEQ ID NO: 1453 - protein, 8 aa, synthetic construct
IDPSESNT

SEQ ID NO: 1454 - protein, 8 aa, synthetic construct
IDPSESNT

SEQ ID NO: 1455 - protein, 8 aa, synthetic construct
IDPSESNT

SEQ ID NO: 1456 - protein, 8 aa, synthetic construct
IDPSESNT

SEQ ID NO: 1457 - protein, 8 aa, synthetic construct
IDPSESNT

SEQ ID NO: 1458 - protein, 8 aa, synthetic construct
IDPSESNT

SEQ ID NO: 1459 - protein, 8 aa, synthetic construct
IDPSESNT

SEQ ID NO: 1460 - protein, 8 aa, synthetic construct
IDPSESNT

SEQ ID NO: 1461 - protein, 8 aa, synthetic construct
IDPSESNT

SEQ ID NO: 1462 - protein, 8 aa, synthetic construct
IDPSESNT

SEQ ID NO: 1463 - protein, 8 aa, synthetic construct
IDPSESNT

SEQ ID NO: 1464 - protein, 8 aa, synthetic construct
IDPSESNT

SEQ ID NO: 1465 - protein, 8 aa, synthetic construct
IDPSESNT

SEQ ID NO: 1466 - protein, 8 aa, synthetic construct
IDPSESNT

SEQ ID NO: 1467 - protein, 8 aa, synthetic construct
IDPSESNT

SEQ ID NO: 1468 - protein, 8 aa, synthetic construct
IDPSESNT

SEQ ID NO: 1469 - protein, 8 aa, synthetic construct
IDPSESNT

SEQ ID NO: 1470 - protein, 8 aa, synthetic construct
IDPSESNT

SEQ ID NO: 1471 - protein, 8 aa, synthetic construct
IDPSESNT

SEQ ID NO: 1472 - protein, 8 aa, synthetic construct
IDPSESNT

SEQ ID NO: 1473 - protein, 8 aa, synthetic construct
IDPSESNT

SEQ ID NO: 1474 - protein, 8 aa, synthetic construct
IDPSESNT

SEQ ID NO: 1475 - protein, 8 aa, synthetic construct
IDPSESNT

SEQ ID NO: 1476 - protein, 8 aa, synthetic construct
IDPSESNT

SEQ ID NO: 1477 - protein, 8 aa, synthetic construct
IDPSESNT

SEQ ID NO: 1478 - protein, 8 aa, synthetic construct
IDPSESNT

SEQ ID NO: 1479 - protein, 8 aa, synthetic construct
IDPSESNT

SEQ ID NO: 1480 - protein, 8 aa, synthetic construct
IDPSESNT

SEQ ID NO: 1481 - protein, 8 aa, synthetic construct
IDPSESNT

SEQ ID NO: 1482 - protein, 8 aa, synthetic construct
IDPSESNT

SEQ ID NO: 1483 - protein, 8 aa, synthetic construct
IDPSESNT

SEQ ID NO: 1484 - protein, 8 aa, synthetic construct
IDPSESNT

SEQ ID NO: 1485 - protein, 14 aa, synthetic construct
ARGGYDGWDYAIDY

SEQ ID NO: 1486 - protein, 14 aa, synthetic construct
ARGGYDGWDYAIDY

SEQ ID NO: 1487 - protein, 14 aa, synthetic construct
ARGGYDGWDYAIDY

SEQ ID NO: 1488 - protein, 14 aa, synthetic construct
ARGGYDGWDYAIDY

SEQ ID NO: 1489 - protein, 14 aa, synthetic construct
ARGGYDGWDYAIDY

SEQ ID NO: 1490 - protein, 14 aa, synthetic construct
ARGGYDGWDYAIDY

SEQ ID NO: 1491 - protein, 14 aa, synthetic construct
ARGGYDGWDYAIDY

SEQ ID NO: 1492 - protein, 14 aa, synthetic construct
ARGGYDGWDYAIDY

SEQ ID NO: 1493 - protein, 14 aa, synthetic construct
ARGGYDGWDYAIDY

SEQ ID NO: 1494 - protein, 14 aa, synthetic construct
ARGGYDGWDYAIDY

SEQ ID NO: 1495 - protein, 14 aa, synthetic construct
ARGGYDGWDYAIDY

SEQ ID NO: 1496 - protein, 14 aa, synthetic construct
ARGGYDGWDYAIDY

SEQ ID NO: 1497 - protein, 14 aa, synthetic construct
ARGGYDGWDYAIDY

SEQ ID NO: 1498 - protein, 14 aa, synthetic construct
ARGGYDGWDYAIDY

SEQ ID NO: 1499 - protein, 14 aa, synthetic construct
ARGGYDGWDYAIDY

SEQ ID NO: 1500 - protein, 14 aa, synthetic construct
ARGGYDGWDYAIDY

SEQ ID NO: 1501 - protein, 14 aa, synthetic construct
ARGGYDGWDYAIDY

SEQ ID NO: 1502 - protein, 14 aa, synthetic construct
ARGGYDGWDYAIDY

SEQ ID NO: 1503 - protein, 14 aa, synthetic construct
ARGGYDGWDYFIDY

SEQ ID NO: 1504 - protein, 14 aa, synthetic construct
ARGGYDGWDYFIYY

SEQ ID NO: 1505 - protein, 14 aa, synthetic construct
ARGGYDGWDYLIDY

SEQ ID NO: 1506 - protein, 14 aa, synthetic construct
ARGGYDGWDYVIDY

SEQ ID NO: 1507 - protein, 14 aa, synthetic construct
ARGGYDGWDYVIYY

SEQ ID NO: 1508 - protein, 14 aa, synthetic construct
ARGGYDGWDYWIDY

SEQ ID NO: 1509 - protein, 14 aa, synthetic construct
ARGGYDGWDYYIDY

SEQ ID NO: 1510 - protein, 14 aa, synthetic construct
ARGGYDGWDYYIYY

SEQ ID NO: 1511 - protein, 14 aa, synthetic construct
IRGGYDGWDYAIDY

SEQ ID NO: 1512 - protein, 14 aa, synthetic construct
LRGGYDGWDYAIDY

SEQ ID NO: 1513 - protein, 14 aa, synthetic construct
MRGGYDGWDYAIDY

SEQ ID NO: 1514 - protein, 14 aa, synthetic construct
RRGGYDGWDYAIDY

SEQ ID NO: 1515 - protein, 14 aa, synthetic construct
VRGGYDGWDYAIDY

SEQ ID NO: 1516 - protein, 14 aa, synthetic construct
ARGGYWGWDYAIDY

SEQ ID NO: 1517 - protein, 14 aa, synthetic construct
ARGGYYGWDYAIDY

SEQ ID NO: 1518 - protein, 14 aa, synthetic construct
ARGGYDGWDYAIFY

SEQ ID NO: 1519 - protein, 14 aa, synthetic construct
ARGGYDGWDYAIMY

SEQ ID NO: 1520 - protein, 14 aa, synthetic construct
ARGGYDGWDYAIWY

SEQ ID NO: 1521 - protein, 14 aa, synthetic construct
ARGGYDGWDYAIYY

SEQ ID NO: 1522 - protein, 14 aa, synthetic construct
ARGFYDGWDYAIDY

SEQ ID NO: 1523 - protein, 14 aa, synthetic construct
ARGFYDGWDYLIDY

SEQ ID NO: 1524 - protein, 14 aa, synthetic construct
ARGFYDGWDYAIYY

SEQ ID NO: 1525 - protein, 14 aa, synthetic construct
ARGMYDGWDYAIDY

SEQ ID NO: 1526 - protein, 14 aa, synthetic construct
ARGRYDGWDYAIDY

SEQ ID NO: 1527 - protein, 14 aa, synthetic construct
ARGVYDGWDYAIDY

SEQ ID NO: 1528 - protein, 14 aa, synthetic construct
ARGGYDIWDYAIDY

SEQ ID NO: 1529 - protein, 14 aa, synthetic construct
ARGGYDLWDYAIDY

SEQ ID NO: 1530 - protein, 14 aa, synthetic construct
ARGGYDVWDYAIDY

SEQ ID NO: 1531 - protein, 14 aa, synthetic construct
ARFGYDGWDYAIDY

SEQ ID NO: 1532 - protein, 14 aa, synthetic construct
ARYGYDGWDYAIDY

SEQ ID NO: 1533 - protein, 14 aa, synthetic construct
ARGGYDGWDYAIDY

SEQ ID NO: 1534 - protein, 14 aa, synthetic construct
ARGGYDGWDYAIDY

SEQ ID NO: 1535 - protein, 14 aa, synthetic construct
ARGGYDGWDYAIDY

SEQ ID NO: 1536 - protein, 14 aa, synthetic construct
ARGGYDGWDYAIDY

SEQ ID NO: 1537 - protein, 14 aa, synthetic construct
ARGGYDGWDYAIDY

SEQ ID NO: 1538 - protein, 14 aa, synthetic construct
ARGGYDGWDYAIDY

SEQ ID NO: 1539 - protein, 14 aa, synthetic construct
ARGGYDGWDYAIDY

SEQ ID NO: 1540 - protein, 14 aa, synthetic construct
ARGGYDGWDYAIDY

SEQ ID NO: 1541 - protein, 14 aa, synthetic construct
ARGGYDGWDYAIDY

SEQ ID NO: 1542 - protein, 14 aa, synthetic construct
ARGGYDGWDYAIDY

SEQ ID NO: 1543 - protein, 14 aa, synthetic construct
ARGGYDGWDYAIDY

SEQ ID NO: 1544 - protein, 14 aa, synthetic construct
ARGGYDGWDYAIDY

SEQ ID NO: 1545 - protein, 14 aa, synthetic construct
ARGGYDGWDYAIDY

SEQ ID NO: 1546 - protein, 14 aa, synthetic construct
ARGGYDGWDYAIDY

SEQ ID NO: 1547 - protein, 14 aa, synthetic construct
ARGGYDGWDYAIDY

SEQ ID NO: 1548 - protein, 14 aa, synthetic construct
ARGGYDGWDYAIDY

SEQ ID NO: 1549 - protein, 14 aa, synthetic construct
ARGGYDGWDYAIDY

SEQ ID NO: 1550 - protein, 14 aa, synthetic construct
ARGGYDGWDYAIDY

SEQ ID NO: 1551 - protein, 14 aa, synthetic construct
ARGGYDGWDYAIDY

SEQ ID NO: 1552 - protein, 14 aa, synthetic construct
ARGGYDGWDYAIDY

SEQ ID NO: 1553 - protein, 14 aa, synthetic construct
ARGGYDGWDYAIDY

SEQ ID NO: 1554 - protein, 14 aa, synthetic construct
ARGGYDGWDYAIDY

SEQ ID NO: 1555 - protein, 14 aa, synthetic construct
ARGGYDGWDYAIDY

SEQ ID NO: 1556 - protein, 14 aa, synthetic construct
ARGGYDGWDYAIDY

SEQ ID NO: 1557 - protein, 14 aa, synthetic construct
ARGGYDGWDYAIDY

SEQ ID NO: 1558 - protein, 14 aa, synthetic construct
ARGGYDGWDYAIDY

SEQ ID NO: 1559 - protein, 14 aa, synthetic construct
ARGGYDGWDYAIDY

SEQ ID NO: 1560 - protein, 14 aa, synthetic construct
ARGGYDGWDYAIDY

SEQ ID NO: 1561 - protein, 14 aa, synthetic construct
ARGGYDGWDYAIDY

SEQ ID NO: 1562 - protein, 14 aa, synthetic construct
ARGGYDGWDYAIDY

SEQ ID NO: 1563 - protein, 14 aa, synthetic construct
ARGGYDGWDYAIDY

SEQ ID NO: 1564 - protein, 14 aa, synthetic construct
ARGGYDGWDYAIDY

SEQ ID NO: 1565 - protein, 14 aa, synthetic construct
ARGGYDGWDYAIDY

SEQ ID NO: 1566 - protein, 14 aa, synthetic construct
ARGGYDGWDYAIDY

SEQ ID NO: 1567 - protein, 14 aa, synthetic construct
ARGGYDGWDYAIDY

SEQ ID NO: 1568 - protein, 14 aa, synthetic construct
ARGGYDGWDYAIDY

SEQ ID NO: 1569 - protein, 14 aa, synthetic construct
ARGGYDGWDYAIDY

SEQ ID NO: 1570 - protein, 14 aa, synthetic construct
ARGGYDGWDYAIDY

SEQ ID NO: 1571 - protein, 14 aa, synthetic construct
ARGGYDGWDYAIDY

SEQ ID NO: 1572 - protein, 14 aa, synthetic construct
ARGGYDGWDYAIDY

SEQ ID NO: 1573 - protein, 14 aa, synthetic construct
ARGGYDGWDYAIDY

SEQ ID NO: 1574 - protein, 14 aa, synthetic construct
ARGGYDGWDYAIDY

SEQ ID NO: 1575 - protein, 14 aa, synthetic construct
ARGGYDGWDYAIDY

SEQ ID NO: 1576 - protein, 14 aa, synthetic construct
ARGGYDGWDYAIDY

SEQ ID NO: 1577 - protein, 14 aa, synthetic construct
ARGGYDGWDYAIDY

SEQ ID NO: 1578 - protein, 14 aa, synthetic construct
ARGGYDGWDYAIDY

SEQ ID NO: 1579 - protein, 14 aa, synthetic construct
ARGGYDGWDYAIDY

SEQ ID NO: 1580 - protein, 14 aa, synthetic construct
ARGGYDGWDYAIDY

SEQ ID NO: 1581 - protein, 14 aa, synthetic construct
ARGGYDGWDYAIDY

SEQ ID NO: 1582 - protein, 14 aa, synthetic construct
ARGGYDGWDYAIDY

SEQ ID NO: 1583 - protein, 14 aa, synthetic construct
ARGGYDGWDYAIDY

SEQ ID NO: 1584 - protein, 14 aa, synthetic construct
ARGGYDGWDYAIDY

SEQ ID NO: 1585 - protein, 14 aa, synthetic construct
ARGGYDGWDYAIDY

SEQ ID NO: 1586 - protein, 14 aa, synthetic construct
ARGGYDGWDYAIDY

SEQ ID NO: 1587 - protein, 14 aa, synthetic construct
ARGGYDGWDYAIDY

SEQ ID NO: 1588 - protein, 14 aa, synthetic construct
ARGGYDGWDYAIDY

SEQ ID NO: 1589 - protein, 14 aa, synthetic construct
ARGGYDGWDYAIDY

SEQ ID NO: 1590 - protein, 14 aa, synthetic construct
ARGGYDGWDYAIDY

SEQ ID NO: 1591 - protein, 11 aa, synthetic construct
QSLAKSYGNTY

SEQ ID NO: 1592 - protein, 11 aa, synthetic construct
QSLAKSYGNTY

SEQ ID NO: 1593 - protein, 11 aa, synthetic construct
QSLAKSYGNTY

SEQ ID NO: 1594 - protein, 11 aa, synthetic construct
QSLAKSYGNTY

SEQ ID NO: 1595 - protein, 11 aa, synthetic construct
QSLAKSYGNTY

SEQ ID NO: 1596 - protein, 11 aa, synthetic construct
QSLAKSYGNTY

SEQ ID NO: 1597 - protein, 11 aa, synthetic construct
QSLAKSYGNTY

SEQ ID NO: 1598 - protein, 11 aa, synthetic construct
QSLAKSYGNTY

SEQ ID NO: 1599 - protein, 11 aa, synthetic construct
QSLAKSYGNTY

SEQ ID NO: 1600 - protein, 11 aa, synthetic construct
QSLAKSYGNTY

SEQ ID NO: 1601 - protein, 11 aa, synthetic construct
QSLAKSYGNTY

SEQ ID NO: 1602 - protein, 11 aa, synthetic construct
QSLAKSYGNTY

SEQ ID NO: 1603 - protein, 11 aa, synthetic construct
QSLAKSYGNTY

SEQ ID NO: 1604 - protein, 11 aa, synthetic construct
QSLAKSYGNTY

SEQ ID NO: 1605 - protein, 11 aa, synthetic construct
QSLAKSYGNTY

SEQ ID NO: 1606 - protein, 11 aa, synthetic construct
QSLAKSYGNTY

SEQ ID NO: 1607 - protein, 11 aa, synthetic construct
QSLAKSYGNTY

SEQ ID NO: 1608 - protein, 11 aa, synthetic construct
QSLAKSYGNTY

SEQ ID NO: 1609 - protein, 11 aa, synthetic construct
QSLAKSYGNTY

SEQ ID NO: 1610 - protein, 11 aa, synthetic construct
QSLAKSYGNTY

SEQ ID NO: 1611 - protein, 11 aa, synthetic construct
QSLAKSYGNTY

SEQ ID NO: 1612 - protein, 11 aa, synthetic construct
QSLAKSYGNTY

SEQ ID NO: 1613 - protein, 11 aa, synthetic construct
QSLAKSYGNTY

SEQ ID NO: 1614 - protein, 11 aa, synthetic construct
QSLAKSYGNTY

SEQ ID NO: 1615 - protein, 11 aa, synthetic construct
QSLAKSYGNTY

SEQ ID NO: 1616 - protein, 11 aa, synthetic construct
QSLAKSYGNTY

SEQ ID NO: 1617 - protein, 11 aa, synthetic construct
QSLAKSYGNTY

SEQ ID NO: 1618 - protein, 11 aa, synthetic construct
QSLAKSYGNTY

SEQ ID NO: 1619 - protein, 11 aa, synthetic construct
QSLAKSYGNTY

SEQ ID NO: 1620 - protein, 11 aa, synthetic construct
QSLAKSYGNTY

SEQ ID NO: 1621 - protein, 11 aa, synthetic construct
QSLAKSYGNTY

SEQ ID NO: 1622 - protein, 11 aa, synthetic construct
QSLAKSYGNTY

SEQ ID NO: 1623 - protein, 11 aa, synthetic construct
QSLAKSYGNTY

SEQ ID NO: 1624 - protein, 11 aa, synthetic construct
QSLAKSYGNTY

SEQ ID NO: 1625 - protein, 11 aa, synthetic construct
QSLAKSYGNTY

SEQ ID NO: 1626 - protein, 11 aa, synthetic construct
QSLAKSYGNTY

SEQ ID NO: 1627 - protein, 11 aa, synthetic construct
QSLAKSYGNTY

SEQ ID NO: 1628 - protein, 11 aa, synthetic construct
QSLAKSYGNTY

SEQ ID NO: 1629 - protein, 11 aa, synthetic construct
QSLAKSYGNTY

SEQ ID NO: 1630 - protein, 11 aa, synthetic construct
QSLAKSYGNTY

SEQ ID NO: 1631 - protein, 11 aa, synthetic construct
QSLAKSYGNTY

SEQ ID NO: 1632 - protein, 11 aa, synthetic construct
QSLAKSYGNTY

SEQ ID NO: 1633 - protein, 11 aa, synthetic construct
QSLAKSYGNTY

SEQ ID NO: 1634 - protein, 11 aa, synthetic construct
QSLAKSYGNTY

SEQ ID NO: 1635 - protein, 11 aa, synthetic construct
QSLAKSYGNTY

SEQ ID NO: 1636 - protein, 11 aa, synthetic construct
QSLAKSYGNTY

SEQ ID NO: 1637 - protein, 11 aa, synthetic construct
QSLAKSYGNTY

SEQ ID NO: 1638 - protein, 11 aa, synthetic construct
QSLAKSYGNTY

SEQ ID NO: 1639 - protein, 11 aa, synthetic construct
QSLAASYGNTY

SEQ ID NO: 1640 - protein, 11 aa, synthetic construct
QSLADSYGNTY

SEQ ID NO: 1641 - protein, 11 aa, synthetic construct
QSLAISYGNTY

SEQ ID NO: 1642 - protein, 11 aa, synthetic construct
QSLAIFYGNTY

SEQ ID NO: 1643 - protein, 11 aa, synthetic construct
QSLAIFYGITY

SEQ ID NO: 1644 - protein, 11 aa, synthetic construct
QSLAIFYGLTY

SEQ ID NO: 1645 - protein, 11 aa, synthetic construct
QSLAILYGITY

SEQ ID NO: 1646 - protein, 11 aa, synthetic construct
QSLAILYGLTY

SEQ ID NO: 1647 - protein, 11 aa, synthetic construct
QSLALSYGNTY

SEQ ID NO: 1648 - protein, 11 aa, synthetic construct
QSLAMSYGNTY

SEQ ID NO: 1649 - protein, 11 aa, synthetic construct
QSLANSYGNTY

SEQ ID NO: 1650 - protein, 11 aa, synthetic construct
QSLAPSYGNTY

SEQ ID NO: 1651 - protein, 11 aa, synthetic construct
QSLAQSYGNTY

SEQ ID NO: 1652 - protein, 11 aa, synthetic construct
QSLARSYGNTY

SEQ ID NO: 1653 - protein, 11 aa, synthetic construct
QSLARFYGLTY

SEQ ID NO: 1654 - protein, 11 aa, synthetic construct
QSLASSYGNTY

SEQ ID NO: 1655 - protein, 11 aa, synthetic construct
QSLATSYGNTY

SEQ ID NO: 1656 - protein, 11 aa, synthetic construct
QSLATYYGITY

SEQ ID NO: 1657 - protein, 11 aa, synthetic construct
QSLATYYGLTY

SEQ ID NO: 1658 - protein, 11 aa, synthetic construct
QSLAVSYGNTY

SEQ ID NO: 1659 - protein, 11 aa, synthetic construct
QSLAYSYGNTY

SEQ ID NO: 1660 - protein, 11 aa, synthetic construct
QSLAYFYGITY

SEQ ID NO: 1661 - protein, 11 aa, synthetic construct
QSLAYLYGITY

SEQ ID NO: 1662 - protein, 11 aa, synthetic construct
QSLAKSYGITY

SEQ ID NO: 1663 - protein, 11 aa, synthetic construct
QSLAKSYGLTY

SEQ ID NO: 1664 - protein, 11 aa, synthetic construct
QSLAKFYGNTY

SEQ ID NO: 1665 - protein, 11 aa, synthetic construct
QSLAKIYGNTY

SEQ ID NO: 1666 - protein, 11 aa, synthetic construct
QSLAKLYGNTY

SEQ ID NO: 1667 - protein, 11 aa, synthetic construct
QSLAKMYGNTY

SEQ ID NO: 1668 - protein, 11 aa, synthetic construct
QSLAKQYGNTY

SEQ ID NO: 1669 - protein, 11 aa, synthetic construct
QSLAKYYGNTY

SEQ ID NO: 1670 - protein, 11 aa, synthetic construct
QSLAKSHGNTY

SEQ ID NO: 1671 - protein, 11 aa, synthetic construct
QSLAKSYGNTY

SEQ ID NO: 1672 - protein, 11 aa, synthetic construct
QSLAKSYGNTY

SEQ ID NO: 1673 - protein, 11 aa, synthetic construct
QSLAKSYGNTY

SEQ ID NO: 1674 - protein, 11 aa, synthetic construct
QSLAKSYGNTY

SEQ ID NO: 1675 - protein, 11 aa, synthetic construct
QSLAKSYGNTY

SEQ ID NO: 1676 - protein, 11 aa, synthetic construct
QSLAKSYGNTY

SEQ ID NO: 1677 - protein, 11 aa, synthetic construct
QSLAKSYGNTY

SEQ ID NO: 1678 - protein, 11 aa, synthetic construct
QSLAKSYGNTY

SEQ ID NO: 1679 - protein, 11 aa, synthetic construct
QSLAKSYGNTY

SEQ ID NO: 1680 - protein, 11 aa, synthetic construct
QSLAKSYGNTY

SEQ ID NO: 1681 - protein, 11 aa, synthetic construct
QSLAKSYGNTY

SEQ ID NO: 1682 - protein, 11 aa, synthetic construct
QSLAKSYGNTY

SEQ ID NO: 1683 - protein, 11 aa, synthetic construct
QSLAKSYGNTY

SEQ ID NO: 1684 - protein, 11 aa, synthetic construct
QSLAKSYGNTY

SEQ ID NO: 1685 - protein, 11 aa, synthetic construct
QSLAKSYGNTY

SEQ ID NO: 1686 - protein, 11 aa, synthetic construct
QSLAKSYGNTY

SEQ ID NO: 1687 - protein, 11 aa, synthetic construct
QSLAKSYGNTY

SEQ ID NO: 1688 - protein, 11 aa, synthetic construct
QSLAKSYGNTY

SEQ ID NO: 1689 - protein, 11 aa, synthetic construct
QSLAKSYGNTY

SEQ ID NO: 1690 - protein, 11 aa, synthetic construct
QSLAKSYGNTY

SEQ ID NO: 1691 - protein, 11 aa, synthetic construct
QSLAKSYGNTY

SEQ ID NO: 1692 - protein, 11 aa, synthetic construct
QSLAKSYGNTY

SEQ ID NO: 1693 - protein, 11 aa, synthetic construct
QSLAKSYGNTY

SEQ ID NO: 1694 - protein, 11 aa, synthetic construct
QSLAKSYGNTY

SEQ ID NO: 1695 - protein, 11 aa, synthetic construct
QSLAKSYGNTY

SEQ ID NO: 1696 - protein, 11 aa, synthetic construct
QSLAKSYGNTY

SEQ ID NO: 1697-1802 - skipped (106 entries)

SEQ ID NO: 1803 - protein, 9 aa, synthetic construct
LQGTHQPYT

SEQ ID NO: 1804 - protein, 9 aa, synthetic construct
LQGTHQPYT

SEQ ID NO: 1805 - protein, 9 aa, synthetic construct
LQGTHQPYT

SEQ ID NO: 1806 - protein, 9 aa, synthetic construct
LQGTHQPYT

SEQ ID NO: 1807 - protein, 9 aa, synthetic construct
LQGTHQPYT

SEQ ID NO: 1808 - protein, 9 aa, synthetic construct
LQGTHQPYT

SEQ ID NO: 1809 - protein, 9 aa, synthetic construct
LQGTHQPYT

SEQ ID NO: 1810 - protein, 9 aa, synthetic construct
LQGTHQPYT

SEQ ID NO: 1811 - protein, 9 aa, synthetic construct
LQGTHQPYT

SEQ ID NO: 1812 - protein, 9 aa, synthetic construct
LQGTHQPYT

SEQ ID NO: 1813 - protein, 9 aa, synthetic construct
LQGTHQPYT

SEQ ID NO: 1814 - protein, 9 aa, synthetic construct
LQGTHQPYT

SEQ ID NO: 1815 - protein, 9 aa, synthetic construct
LQGTHQPYT

SEQ ID NO: 1816 - protein, 9 aa, synthetic construct
LQGTHQPYT

SEQ ID NO: 1817 - protein, 9 aa, synthetic construct
LQGTHQPYT

SEQ ID NO: 1818 - protein, 9 aa, synthetic construct
LQGTHQPYT

SEQ ID NO: 1819 - protein, 9 aa, synthetic construct
LQGTHQPYT

SEQ ID NO: 1820 - protein, 9 aa, synthetic construct
LQGTHQPYT

SEQ ID NO: 1821 - protein, 9 aa, synthetic construct
LQGTHQPYT

SEQ ID NO: 1822 - protein, 9 aa, synthetic construct
LQGTHQPYT

SEQ ID NO: 1823 - protein, 9 aa, synthetic construct
LQGTHQPYT

SEQ ID NO: 1824 - protein, 9 aa, synthetic construct
LQGTHQPYT

SEQ ID NO: 1825 - protein, 9 aa, synthetic construct
LQGTHQPYT

SEQ ID NO: 1826 - protein, 9 aa, synthetic construct
LQGTHQPYT

SEQ ID NO: 1827 - protein, 9 aa, synthetic construct
LQGTHQPYT

SEQ ID NO: 1828 - protein, 9 aa, synthetic construct
LQGTHQPYT

SEQ ID NO: 1829 - protein, 9 aa, synthetic construct
LQGTHQPYT

SEQ ID NO: 1830 - protein, 9 aa, synthetic construct
LQGTHQPYT

SEQ ID NO: 1831 - protein, 9 aa, synthetic construct
LQGTHQPYT

SEQ ID NO: 1832 - protein, 9 aa, synthetic construct
LQGTHQPYT

SEQ ID NO: 1833 - protein, 9 aa, synthetic construct
LQGTHQPYT

SEQ ID NO: 1834 - protein, 9 aa, synthetic construct
LQGTHQPYT

SEQ ID NO: 1835 - protein, 9 aa, synthetic construct
LQGTHQPYT

SEQ ID NO: 1836 - protein, 9 aa, synthetic construct
LQGTHQPYT

SEQ ID NO: 1837 - protein, 9 aa, synthetic construct
LQGTHQPYT

SEQ ID NO: 1838 - protein, 9 aa, synthetic construct
LQGTHQPYT

SEQ ID NO: 1839 - protein, 9 aa, synthetic construct
LQGTHQPYT

SEQ ID NO: 1840 - protein, 9 aa, synthetic construct
LQGTHQPYT

SEQ ID NO: 1841 - protein, 9 aa, synthetic construct
LQGTHQPYT

SEQ ID NO: 1842 - protein, 9 aa, synthetic construct
LQGTHQPYT

SEQ ID NO: 1843 - protein, 9 aa, synthetic construct
LQGTHQPYT

SEQ ID NO: 1844 - protein, 9 aa, synthetic construct
LQGTHQPYT

SEQ ID NO: 1845 - protein, 9 aa, synthetic construct
LQGTHQPYT

SEQ ID NO: 1846 - protein, 9 aa, synthetic construct
LQGTHQPYT

SEQ ID NO: 1847 - protein, 9 aa, synthetic construct
LQGTHQPYT

SEQ ID NO: 1848 - protein, 9 aa, synthetic construct
LQGTHQPYT

SEQ ID NO: 1849 - protein, 9 aa, synthetic construct
LQGTHQPYT

SEQ ID NO: 1850 - protein, 9 aa, synthetic construct
LQGTHQPYT

SEQ ID NO: 1851 - protein, 9 aa, synthetic construct
LQGTHQPYT

SEQ ID NO: 1852 - protein, 9 aa, synthetic construct
LQGTHQPYT

SEQ ID NO: 1853 - protein, 9 aa, synthetic construct
LQGTHQPYT

SEQ ID NO: 1854 - protein, 9 aa, synthetic construct
LQGTHQPYT

SEQ ID NO: 1855 - protein, 9 aa, synthetic construct
LQGTHQPYT

SEQ ID NO: 1856 - protein, 9 aa, synthetic construct
LQGTHQPYT

SEQ ID NO: 1857 - protein, 9 aa, synthetic construct
LQGTHQPYT

SEQ ID NO: 1858 - protein, 9 aa, synthetic construct
LQGTHQPYT

SEQ ID NO: 1859 - protein, 9 aa, synthetic construct
LQGTHQPYT

SEQ ID NO: 1860 - protein, 9 aa, synthetic construct
LQGTHQPYT

SEQ ID NO: 1861 - protein, 9 aa, synthetic construct
LQGTHQPYT

SEQ ID NO: 1862 - protein, 9 aa, synthetic construct
LQGTHQPYT

SEQ ID NO: 1863 - protein, 9 aa, synthetic construct
LQGTHQPYT

SEQ ID NO: 1864 - protein, 9 aa, synthetic construct
LQGTHQPYT

SEQ ID NO: 1865 - protein, 9 aa, synthetic construct
LQGTHQPYT

SEQ ID NO: 1866 - protein, 9 aa, synthetic construct
LQGTHQPYT

SEQ ID NO: 1867 - protein, 9 aa, synthetic construct
LQGTHQPYT

SEQ ID NO: 1868 - protein, 9 aa, synthetic construct
LQGTHQPYT

SEQ ID NO: 1869 - protein, 9 aa, synthetic construct
LQGTHQPYT

SEQ ID NO: 1870 - protein, 9 aa, synthetic construct
LQGTHQPYT

SEQ ID NO: 1871 - protein, 9 aa, synthetic construct
LQGTHQPYT

SEQ ID NO: 1872 - protein, 9 aa, synthetic construct
LQGTHQPYT

SEQ ID NO: 1873 - protein, 9 aa, synthetic construct
LQGTHQPYT

SEQ ID NO: 1874 - protein, 9 aa, synthetic construct
LQGTHQPYT

SEQ ID NO: 1875 - protein, 9 aa, synthetic construct
LQGTHQPYT

SEQ ID NO: 1876 - protein, 9 aa, synthetic construct
LQGTHQPYT

SEQ ID NO: 1877 - protein, 9 aa, synthetic construct
LQGTHQPYT

SEQ ID NO: 1878 - protein, 9 aa, synthetic construct
LQGTHQPYT

SEQ ID NO: 1879 - protein, 9 aa, synthetic construct
LQGTHQPYT

SEQ ID NO: 1880 - protein, 9 aa, synthetic construct
LQGTHQPYT

SEQ ID NO: 1881 - protein, 9 aa, synthetic construct
LQGTHQPYT

SEQ ID NO: 1882 - protein, 9 aa, synthetic construct
LQGTHQPYT

SEQ ID NO: 1883 - protein, 9 aa, synthetic construct
LQGTHQPYT

SEQ ID NO: 1884 - protein, 9 aa, synthetic construct
LQGTHQPYT

SEQ ID NO: 1885 - protein, 9 aa, synthetic construct
LQGTHQPYT

SEQ ID NO: 1886 - protein, 9 aa, synthetic construct
LQFTHQPYT

SEQ ID NO: 1887 - protein, 9 aa, synthetic construct
LQFTIQFYT

SEQ ID NO: 1888 - protein, 9 aa, synthetic construct
LQFTIQVYT

SEQ ID NO: 1889 - protein, 9 aa, synthetic construct
LQFTIQPYI

SEQ ID NO: 1890 - protein, 9 aa, synthetic construct
LQFTHQFYT

SEQ ID NO: 1891 - protein, 9 aa, synthetic construct
LQFTHQIYI

SEQ ID NO: 1892 - protein, 9 aa, synthetic construct
LQFTHQPYI

SEQ ID NO: 1893 - protein, 9 aa, synthetic construct
LQRTHQPYT

SEQ ID NO: 1894 - protein, 9 aa, synthetic construct
LQRTIQVYI

SEQ ID NO: 1895 - protein, 9 aa, synthetic construct
LQRTIQYYT

SEQ ID NO: 1896 - protein, 9 aa, synthetic construct
LQVTHQPYT

SEQ ID NO: 1897 - protein, 9 aa, synthetic construct
LQWTHQPYT

SEQ ID NO: 1898 - protein, 9 aa, synthetic construct
LQYTHQPYT

SEQ ID NO: 1899 - protein, 9 aa, synthetic construct
LQYTIQFYI

SEQ ID NO: 1900 - protein, 9 aa, synthetic construct
LQYTHQFYI

SEQ ID NO: 1901 - protein, 9 aa, synthetic construct
LQGTIQPYT

SEQ ID NO: 1902 - protein, 9 aa, synthetic construct
LQGTWQPYT

SEQ ID NO: 1903 - protein, 9 aa, synthetic construct
LQGTHQFYT

SEQ ID NO: 1904 - protein, 9 aa, synthetic construct
LQGTHQIYT

SEQ ID NO: 1905 - protein, 9 aa, synthetic construct
LQGTHQVYT

SEQ ID NO: 1906 - protein, 9 aa, synthetic construct
LQGTHQYYT

SEQ ID NO: 1907 - protein, 9 aa, synthetic construct
LQGTHQPYI

SEQ ID NO: 1908 - protein, 9 aa, synthetic construct
LQGTHQPYR

SEQ ID NO: 1909 - protein, 121 aa, synthetic construct
EVQLVQSGAEVKKPGSSVKVSCKASGGTFTSYWMHWVRQAPGQGLEWMGEIDPSESNTNYNQKFKGRATITADISTSTAYMELSSLRSEDTAVYYCARGGYDGWDYAIDYWGQGTLVTVSS

SEQ ID NO: 1910 - protein, 121 aa, synthetic construct
EVQLVESGGGVVQPGRSLRLSCAASGYTFTSYWMHWVRQAPGKGLEWIGEIDPSESNTNYNQKFKGRATISVDNSKNTAYLQMSSLRAEDTAVYYCARGGYDGWDYAIDYWGQGTLVTVSS

SEQ ID NO: 1911 - protein, 121 aa, synthetic construct
QVQLVQSGAEVKKPGASVKVSCKGSGYTFTIYWMHWVRQAPGQRLEWIGEIDPSESNTNYNQKFKGRVTLTVDISASTAYMELSSLRSEDTAVYYCARGGYDGWDYAIDYWGQGTLVTVSS

SEQ ID NO: 1912 - protein, 121 aa, synthetic construct
QVQLVQSGAEVKKPGASVKVSCKGSGYTFTVYWMHWVRQAPGQRLEWIGEIDPSESNTNYNQKFKGRVTLTVDISASTAYMELSSLRSEDTAVYYCARGGYDGWDYAIDYWGQGTLVTVSS

SEQ ID NO: 1913 - protein, 121 aa, synthetic construct
QVQLVQSGAEVKKPGASVKVSCKGSGYTFTSMWMHWVRQAPGQRLEWIGEIDPSESNTNYNQKFKGRVTLTVDISASTAYMELSSLRSEDTAVYYCARGGYDGWDYAIDYWGQGTLVTVSS

SEQ ID NO: 1914 - protein, 121 aa, synthetic construct
QVQLVQSGAEVKKPGASVKVSCKGSGYTFTSQWMHWVRQAPGQRLEWIGEIDPSESNTNYNQKFKGRVTLTVDISASTAYMELSSLRSEDTAVYYCARGGYDGWDYAIDYWGQGTLVTVSS

SEQ ID NO: 1915 - protein, 121 aa, synthetic construct
QVQLVQSGAEVKKPGASVKVSCKGSGYTFTSYWMHWVRQAPGQRLEWIGEIIPSESNTNYNQKFKGRVTLTVDISASTAYMELSSLRSEDTAVYYCARGGYDGWDYAIDYWGQGTLVTVSS

SEQ ID NO: 1916 - protein, 121 aa, synthetic construct
QVQLVQSGAEVKKPGASVKVSCKGSGYTFTSYWMHWVRQAPGQRLEWIGEIIPLESNTNYNQKFKGRVTLTVDISASTAYMELSSLRSEDTAVYYCARGGYDGWDYAIDYWGQGTLVTVSS

SEQ ID NO: 1917 - protein, 121 aa, synthetic construct
QVQLVQSGAEVKKPGASVKVSCKGSGYTFTSYWMHWVRQAPGQRLEWIGEIIPRESNTNYNQKFKGRVTLTVDISASTAYMELSSLRSEDTAVYYCARGGYDGWDYAIDYWGQGTLVTVSS

SEQ ID NO: 1918 - protein, 121 aa, synthetic construct
QVQLVQSGAEVKKPGASVKVSCKGSGYTFTSYWMHWVRQAPGQRLEWIGEIIPVESNTNYNQKFKGRVTLTVDISASTAYMELSSLRSEDTAVYYCARGGYDGWDYAIDYWGQGTLVTVSS

SEQ ID NO: 1919 - protein, 121 aa, synthetic construct
QVQLVQSGAEVKKPGASVKVSCKGSGYTFTSYWMHWVRQAPGQRLEWIGEIRPSESNTNYNQKFKGRVTLTVDISASTAYMELSSLRSEDTAVYYCARGGYDGWDYAIDYWGQGTLVTVSS

SEQ ID NO: 1920 - protein, 121 aa, synthetic construct
QVQLVQSGAEVKKPGASVKVSCKGSGYTFTSYWMHWVRQAPGQRLEWIGEIRPLESNTNYNQKFKGRVTLTVDISASTAYMELSSLRSEDTAVYYCARGGYDGWDYAIDYWGQGTLVTVSS

SEQ ID NO: 1921 - protein, 121 aa, synthetic construct
QVQLVQSGAEVKKPGASVKVSCKGSGYTFTSYWMHWVRQAPGQRLEWIGEIRPRESNTNYNQKFKGRVTLTVDISASTAYMELSSLRSEDTAVYYCARGGYDGWDYAIDYWGQGTLVTVSS

SEQ ID NO: 1922 - protein, 121 aa, synthetic construct
QVQLVQSGAEVKKPGASVKVSCKGSGYTFTSYWMHWVRQAPGQRLEWIGEIRPVESNTNYNQKFKGRVTLTVDISASTAYMELSSLRSEDTAVYYCARGGYDGWDYAIDYWGQGTLVTVSS

SEQ ID NO: 1923 - protein, 121 aa, synthetic construct
QVQLVQSGAEVKKPGASVKVSCKGSGYTFTSYWMHWVRQAPGQRLEWIGEIDPLESNTNYNQKFKGRVTLTVDISASTAYMELSSLRSEDTAVYYCARGGYDGWDYAIDYWGQGTLVTVSS

SEQ ID NO: 1924 - protein, 121 aa, synthetic construct
QVQLVQSGAEVKKPGASVKVSCKGSGYTFTSYWMHWVRQAPGQRLEWIGEIDPMESNTNYNQKFKGRVTLTVDISASTAYMELSSLRSEDTAVYYCARGGYDGWDYAIDYWGQGTLVTVSS

SEQ ID NO: 1925 - protein, 121 aa, synthetic construct
QVQLVQSGAEVKKPGASVKVSCKGSGYTFTSYWMHWVRQAPGQRLEWIGEIDPRESNTNYNQKFKGRVTLTVDISASTAYMELSSLRSEDTAVYYCARGGYDGWDYAIDYWGQGTLVTVSS

SEQ ID NO: 1926 - protein, 121 aa, synthetic construct
QVQLVQSGAEVKKPGASVKVSCKGSGYTFTSYWMHWVRQAPGQRLEWIGEIDPVESNTNYNQKFKGRVTLTVDISASTAYMELSSLRSEDTAVYYCARGGYDGWDYAIDYWGQGTLVTVSS

SEQ ID NO: 1927 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYFIDYWGQGTLVTVSS

SEQ ID NO: 1928 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYFIYYWGQGTLVTVSS

SEQ ID NO: 1929 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYLIDYWGQGTLVTVSS

SEQ ID NO: 1930 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYVIDYWGQGTLVTVSS

SEQ ID NO: 1931 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYVIYYWGQGTLVTVSS

SEQ ID NO: 1932 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYWIDYWGQGTLVTVSS

SEQ ID NO: 1933 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYYIDYWGQGTLVTVSS

SEQ ID NO: 1934 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYYIYYWGQGTLVTVSS

SEQ ID NO: 1935 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCIRGGYDGWDYAIDYWGQGTLVTVSS

SEQ ID NO: 1936 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCLRGGYDGWDYAIDYWGQGTLVTVSS

SEQ ID NO: 1937 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCMRGGYDGWDYAIDYWGQGTLVTVSS

SEQ ID NO: 1938 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCRRGGYDGWDYAIDYWGQGTLVTVSS

SEQ ID NO: 1939 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCVRGGYDGWDYAIDYWGQGTLVTVSS

SEQ ID NO: 1940 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYWGWDYAIDYWGQGTLVTVSS

SEQ ID NO: 1941 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYYGWDYAIDYWGQGTLVTVSS

SEQ ID NO: 1942 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIFYWGQGTLVTVSS

SEQ ID NO: 1943 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIMYWGQGTLVTVSS

SEQ ID NO: 1944 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIWYWGQGTLVTVSS

SEQ ID NO: 1945 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIYYWGQGTLVTVSS

SEQ ID NO: 1946 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGFYDGWDYAIDYWGQGTLVTVSS

SEQ ID NO: 1947 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGFYDGWDYLIDYWGQGTLVTVSS

SEQ ID NO: 1948 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGFYDGWDYAIYYWGQGTLVTVSS

SEQ ID NO: 1949 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGMYDGWDYAIDYWGQGTLVTVSS

SEQ ID NO: 1950 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGRYDGWDYAIDYWGQGTLVTVSS

SEQ ID NO: 1951 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGVYDGWDYAIDYWGQGTLVTVSS

SEQ ID NO: 1952 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDIWDYAIDYWGQGTLVTVSS

SEQ ID NO: 1953 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDLWDYAIDYWGQGTLVTVSS

SEQ ID NO: 1954 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDVWDYAIDYWGQGTLVTVSS

SEQ ID NO: 1955 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARFGYDGWDYAIDYWGQGTLVTVSS

SEQ ID NO: 1956 - protein, 121 aa, synthetic construct
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARYGYDGWDYAIDYWGQGTLVTVSS

SEQ ID NO: 1957 - protein, 121 aa, synthetic construct [sequence omitted]

SEQ ID NO: 1958 - protein, 121 aa, synthetic construct [sequence omitted]

SEQ ID NO: 1959 - protein, 121 aa, synthetic construct [sequence omitted]

SEQ ID NO: 1960 - protein, 121 aa, synthetic construct [sequence omitted]

SEQ ID NO: 1961 - protein, 121 aa, synthetic construct [sequence omitted]

SEQ ID NO: 1962 - protein, 121 aa, synthetic construct [sequence omitted]

SEQ ID NO: 1963 - protein, 121 aa, synthetic construct [sequence omitted]

SEQ ID NO: 1964 - protein, 121 aa, synthetic construct [sequence omitted]

SEQ ID NO: 1965 - protein, 121 aa, synthetic construct [sequence omitted]

SEQ ID NO: 1966 - protein, 121 aa, synthetic construct [sequence omitted]

SEQ ID NO: 1967 - protein, 121 aa, synthetic construct [sequence omitted]

SEQ ID NO: 1968 - protein, 121 aa, synthetic construct [sequence omitted]

SEQ ID NO: 1969 - protein, 121 aa, synthetic construct [sequence omitted]

SEQ ID NO: 1970 - protein, 121 aa, synthetic construct [sequence omitted]

SEQ ID NO: 1971 - protein, 121 aa, synthetic construct [sequence omitted]

SEQ ID NO: 1972 - protein, 121 aa, synthetic construct [sequence omitted]

SEQ ID NO: 1973 - protein, 121 aa, synthetic construct [sequence omitted]

SEQ ID NO: 1974 - protein, 121 aa, synthetic construct [sequence omitted]

SEQ ID NO: 1975 - protein, 121 aa, synthetic construct [sequence omitted]

SEQ ID NO: 1976 - protein, 121 aa, synthetic construct [sequence omitted]

SEQ ID NO: 1977 - protein, 121 aa, synthetic construct [sequence omitted]

SEQ ID NO: 1978 - protein, 121 aa, synthetic construct [sequence omitted]

SEQ ID NO: 1979 - protein, 121 aa, synthetic construct [sequence omitted]

SEQ ID NO: 1980 - protein, 121 aa, synthetic construct [sequence omitted]

SEQ ID NO: 1981 - protein, 121 aa, synthetic construct [sequence omitted]

SEQ ID NO: 1982 - protein, 121 aa, synthetic construct [sequence omitted]

SEQ ID NO: 1983 - protein, 121 aa, synthetic construct [sequence omitted]

SEQ ID NO: 1984 - protein, 121 aa, synthetic construct [sequence omitted]

SEQ ID NO: 1985 - protein, 121 aa, synthetic construct [sequence omitted]

SEQ ID NO: 1986 - protein, 121 aa, synthetic construct [sequence omitted]

SEQ ID NO: 1987 - protein, 121 aa, synthetic construct [sequence omitted]

SEQ ID NO: 1988 - protein, 121 aa, synthetic construct [sequence omitted]

SEQ ID NO: 1989 - protein, 121 aa, synthetic construct [sequence omitted]

SEQ ID NO: 1990 - protein, 121 aa, synthetic construct [sequence omitted]

SEQ ID NO: 1991 - protein, 121 aa, synthetic construct [sequence omitted]

SEQ ID NO: 1992 - protein, 121 aa, synthetic construct [sequence omitted]

SEQ ID NO: 1993 - protein, 121 aa, synthetic construct [sequence omitted]

SEQ ID NO: 1994 - protein, 121 aa, synthetic construct [sequence omitted]

SEQ ID NO: 1995 - protein, 121 aa, synthetic construct [sequence omitted]

SEQ ID NO: 1996 - protein, 121 aa, synthetic construct [sequence omitted]

SEQ ID NO: 1997 - protein, 121 aa, synthetic construct [sequence omitted]

SEQ ID NO: 1998 - protein, 121 aa, synthetic construct [sequence omitted]

SEQ ID NO: 1999 - protein, 121 aa, synthetic construct [sequence omitted]

SEQ ID NO: 2000 - protein, 121 aa, synthetic construct [sequence omitted]

SEQ ID NO: 2001 - protein, 121 aa, synthetic construct [sequence omitted]

SEQ ID NO: 2002 - protein, 121 aa, synthetic construct [sequence omitted]

SEQ ID NO: 2003 - protein, 121 aa, synthetic construct [sequence omitted]

SEQ ID NO: 2004 - protein, 121 aa, synthetic construct [sequence omitted]

SEQ ID NO: 2005 - protein, 121 aa, synthetic construct [sequence omitted]

SEQ ID NO: 2006 - protein, 121 aa, synthetic construct [sequence omitted]

SEQ ID NO: 2007 - protein, 121 aa, synthetic construct [sequence omitted]

SEQ ID NO: 2008 - protein, 121 aa, synthetic construct [sequence omitted]

SEQ ID NO: 2009 - protein, 121 aa, synthetic construct [sequence omitted]

SEQ ID NO: 2010 - protein, 121 aa, synthetic construct [sequence omitted]

SEQ ID NO: 2011 - protein, 121 aa, synthetic construct [sequence omitted]

SEQ ID NO: 2012 - protein, 121 aa, synthetic construct [sequence omitted]

SEQ ID NO: 2013 - protein, 121 aa, synthetic construct [sequence omitted]

SEQ ID NO: 2014 - protein, 121 aa, synthetic construct [sequence omitted]

SEQ ID NO: 2015 - protein, 112 aa, synthetic construct
DVVMTQTPLSLPVTPGQPASISCRSSQSLAKSYGNTYLSWYLQKPGQSPQLLIYGISNRFSGVPDRFSGSGSGTDFTLKISRVEAEDVGVYYCLQGTHQPYTFGQGTKLEIK

SEQ ID NO: 2016 - protein, 112 aa, synthetic construct; identical to SEQ ID NO: 2015

SEQ ID NO: 2017 - protein, 112 aa, synthetic construct [sequence omitted]

SEQ ID NO: 2018 - protein, 112 aa, synthetic construct [sequence omitted]

SEQ ID NO: 2019 - protein, 112 aa, synthetic construct [sequence omitted]

SEQ ID NO: 2020 - protein, 112 aa, synthetic construct [sequence omitted]

SEQ ID NO: 2021 - protein, 112 aa, synthetic construct [sequence omitted]

SEQ ID NO: 2022 - protein, 112 aa, synthetic construct [sequence omitted]

SEQ ID NO: 2023 - protein, 112 aa, synthetic construct [sequence omitted]

SEQ ID NO: 2024 - protein, 112 aa, synthetic construct [sequence omitted]

SEQ ID NO: 2025 - protein, 112 aa, synthetic construct [sequence omitted]

SEQ ID NO: 2026 - protein, 112 aa, synthetic construct [sequence omitted]

SEQ ID NO: 2027 - protein, 112 aa, synthetic construct [sequence omitted]

SEQ ID NO: 2028 - protein, 112 aa, synthetic construct [sequence omitted]

SEQ ID NO: 2029 - protein, 112 aa, synthetic construct [sequence omitted]

SEQ ID NO: 2030 - protein, 112 aa, synthetic construct [sequence omitted]

SEQ ID NO: 2031 - protein, 112 aa, synthetic construct [sequence omitted]

SEQ ID NO: 2032 - protein, 112 aa, synthetic construct [sequence omitted]

SEQ ID NO: 2033 - protein, 112 aa, synthetic construct [sequence omitted]

SEQ ID NO: 2034 - protein, 112 aa, synthetic construct [sequence omitted]

SEQ ID NO: 2035 - protein, 112 aa, synthetic construct [sequence omitted]

SEQ ID NO: 2036 - protein, 112 aa, synthetic construct [sequence omitted]

SEQ ID NO: 2037 - protein, 112 aa, synthetic construct [sequence omitted]

SEQ ID NO: 2038 - protein, 112 aa, synthetic construct [sequence omitted]

SEQ ID NO: 2039 - protein, 112 aa, synthetic construct [sequence omitted]

SEQ ID NO: 2040 - protein, 112 aa, synthetic construct [sequence omitted]

SEQ ID NO: 2041 - protein, 112 aa, synthetic construct [sequence omitted]

SEQ ID NO: 2042 - protein, 112 aa, synthetic construct [sequence omitted]

SEQ ID NO: 2043 - protein, 112 aa, synthetic construct [sequence omitted]

SEQ ID NO: 2044 - protein, 112 aa, synthetic construct [sequence omitted]

SEQ ID NO: 2045 - protein, 112 aa, synthetic construct [sequence omitted]

SEQ ID NO: 2046 - protein, 112 aa, synthetic construct [sequence omitted]

SEQ ID NO: 2047 - protein, 112 aa, synthetic construct [sequence omitted]

SEQ ID NO: 2048 - protein, 112 aa, synthetic construct [sequence omitted]

SEQ ID NO: 2049 - protein, 112 aa, synthetic construct [sequence omitted]

SEQ ID NO: 2050 - protein, 112 aa, synthetic construct [sequence omitted]

SEQ ID NO: 2051 - protein, 112 aa, synthetic construct [sequence omitted]

SEQ ID NO: 2052 - protein, 112 aa, synthetic construct [sequence omitted]

SEQ ID NO: 2053 - protein, 112 aa, synthetic construct [sequence omitted]

SEQ ID NO: 2054 - protein, 112 aa, synthetic construct [sequence omitted]

SEQ ID NO: 2055 - protein, 112 aa, synthetic construct [sequence omitted]

SEQ ID NO: 2056 - protein, 112 aa, synthetic construct [sequence omitted]

SEQ ID NO: 2057 - protein, 112 aa, synthetic construct [sequence omitted]

SEQ ID NO: 2058 - protein, 112 aa, synthetic construct [sequence omitted]

SEQ ID NO: 2059 - protein, 112 aa, synthetic construct [sequence omitted]

SEQ ID NO: 2060 - protein, 112 aa, synthetic construct [sequence omitted]

SEQ ID NO: 2061 - protein, 112 aa, synthetic construct [sequence omitted]

SEQ ID NO: 2062 - protein, 112 aa, synthetic construct [sequence omitted]

SEQ ID NO: 2063 - protein, 112 aa, synthetic construct
DVVMTQSPLSLPVTPGEPASISCRSSQSLAASYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2064 - protein, 112 aa, synthetic construct
DVVMTQSPLSLPVTPGEPASISCRSSQSLADSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2065 - protein, 112 aa, synthetic construct
DVVMTQSPLSLPVTPGEPASISCRSSQSLAISYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2066 - protein, 112 aa, synthetic construct
DVVMTQSPLSLPVTPGEPASISCRSSQSLAIFYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2067 - protein, 112 aa, synthetic construct
DVVMTQSPLSLPVTPGEPASISCRSSQSLAIFYGITYLSWYLQKPGQSPQLLIYGISNRFSGVPDRFSGSGSGTDFTLKISRVEAEDVGVYYCLQGTHQPYTFGQGTKVEIK

SEQ ID NO: 2068 - protein, 112 aa, synthetic construct
DVVMTQSPLSLPVTPGEPASISCRSSQSLAIFYGLTYLSWYLQKPGQSPQLLIYGISNRFSGVPDRFSGSGSGTDFTLKISRVEAEDVGVYYCLQGTHQPYTFGQGTKVEIK

SEQ ID NO: 2069 - protein, 112 aa, synthetic construct
DVVMTQSPLSLPVTPGEPASISCRSSQSLAILYGITYLSWYLQKPGQSPQLLIYGISNRFSGVPDRFSGSGSGTDFTLKISRVEAEDVGVYYCLQGTHQPYTFGQGTKVEIK

SEQ ID NO: 2070 - protein, 112 aa, synthetic construct
DVVMTQSPLSLPVTPGEPASISCRSSQSLAILYGLTYLSWYLQKPGQSPQLLIYGISNRFSGVPDRFSGSGSGTDFTLKISRVEAEDVGVYYCLQGTHQPYTFGQGTKVEIK

SEQ ID NO: 2071 - protein, 112 aa, synthetic construct
DVVMTQSPLSLPVTPGEPASISCRSSQSLALSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2072 - protein, 112 aa, synthetic construct
DVVMTQSPLSLPVTPGEPASISCRSSQSLAMSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2073 - protein, 112 aa, synthetic construct
DVVMTQSPLSLPVTPGEPASISCRSSQSLANSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2074 - protein, 112 aa, synthetic construct
DVVMTQSPLSLPVTPGEPASISCRSSQSLAPSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2075 - protein, 112 aa, synthetic construct
DVVMTQSPLSLPVTPGEPASISCRSSQSLAQSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2076 - protein, 112 aa, synthetic construct
DVVMTQSPLSLPVTPGEPASISCRSSQSLARSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2077 - protein, 112 aa, synthetic construct
DVVMTQSPLSLPVTPGEPASISCRSSQSLARFYGLTYLSWYLQKPGQSPQLLIYGISNRFSGVPDRFSGSGSGTDFTLKISRVEAEDVGVYYCLQGTHQPYTFGQGTKVEIK

SEQ ID NO: 2078 - protein, 112 aa, synthetic construct
DVVMTQSPLSLPVTPGEPASISCRSSQSLASSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2079 - protein, 112 aa, synthetic construct
DVVMTQSPLSLPVTPGEPASISCRSSQSLATSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2080 - protein, 112 aa, synthetic construct
DVVMTQSPLSLPVTPGEPASISCRSSQSLATYYGITYLSWYLQKPGQSPQLLIYGISNRFSGVPDRFSGSGSGTDFTLKISRVEAEDVGVYYCLQGTHQPYTFGQGTKVEIK

SEQ ID NO: 2081 - protein, 112 aa, synthetic construct
DVVMTQSPLSLPVTPGEPASISCRSSQSLATYYGLTYLSWYLQKPGQSPQLLIYGISNRFSGVPDRFSGSGSGTDFTLKISRVEAEDVGVYYCLQGTHQPYTFGQGTKVEIK

SEQ ID NO: 2082 - protein, 112 aa, synthetic construct
DVVMTQSPLSLPVTPGEPASISCRSSQSLAVSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2083 - protein, 112 aa, synthetic construct
DVVMTQSPLSLPVTPGEPASISCRSSQSLAYSYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2084 - protein, 112 aa, synthetic construct
DVVMTQSPLSLPVTPGEPASISCRSSQSLAYFYGITYLSWYLQKPGQSPQLLIYGISNRFSGVPDRFSGSGSGTDFTLKISRVEAEDVGVYYCLQGTHQPYTFGQGTKVEIK

SEQ ID NO: 2085 - protein, 112 aa, synthetic construct
DVVMTQSPLSLPVTPGEPASISCRSSQSLAYLYGITYLSWYLQKPGQSPQLLIYGISNRFSGVPDRFSGSGSGTDFTLKISRVEAEDVGVYYCLQGTHQPYTFGQGTKVEIK

SEQ ID NO: 2086 - protein, 112 aa, synthetic construct
DVVMTQSPLSLPVTPGEPASISCRSSQSLAKSYGITYLSWYLQKPGQSPQLLIYGISNRFSGVPDRFSGSGSGTDFTLKISRVEAEDVGVYYCLQGTHQPYTFGQGTKVEIK

SEQ ID NO: 2087 - protein, 112 aa, synthetic construct
DVVMTQSPLSLPVTPGEPASISCRSSQSLAKSYGLTYLSWYLQKPGQSPQLLIYGISNRFSGVPDRFSGSGSGTDFTLKISRVEAEDVGVYYCLQGTHQPYTFGQGTKVEIK

SEQ ID NO: 2088 - protein, 112 aa, synthetic construct
DVVMTQSPLSLPVTPGEPASISCRSSQSLAKFYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2089 - protein, 112 aa, synthetic construct
DVVMTQSPLSLPVTPGEPASISCRSSQSLAKIYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2090 - protein, 112 aa, synthetic construct
DVVMTQSPLSLPVTPGEPASISCRSSQSLAKLYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2091 - protein, 112 aa, synthetic construct
DVVMTQSPLSLPVTPGEPASISCRSSQSLAKMYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2092 - protein, 112 aa, synthetic construct
DVVMTQSPLSLPVTPGEPASISCRSSQSLAKQYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2093 - protein, 112 aa, synthetic construct
DVVMTQSPLSLPVTPGEPASISCRSSQSLAKYYGNTYLSWYLQKPGQSPQLLIYGISNRFSGVPDRFSGSGSGTDFTLKISRVEAEDVGVYYCLQGTHQPYTFGQGTKVEIK

SEQ ID NO: 2094 - protein, 112 aa, synthetic construct
DVVMTQSPLSLPVTPGEPASISCRSSQSLAKSHGNTYLSWYLQKPGQSPQLLIYGISNRFSGVPDRFSGSGSGTDFTLKISRVEAEDVGVYYCLQGTHQPYTFGQGTKVEIK

SEQ ID NO: 2095 - protein, 112 aa, synthetic construct
DVVMTQSPLSLPVTPGEPASISCRSSQSLAKSYGNTYLSWYLQKPGQSPQLLIYFISNRFSGVPDRFSGSGSGTDFTLKISRVEAEDVGVYYCLQGTHQPYTFGQGTKVEIK

SEQ ID NO: 2096 - protein, 112 aa, synthetic construct
DVVMTQSPLSLPVTPGEPASISCRSSQSLAKSYGNTYLSWYLQKPGQSPQLLIYPISNRFSGVPDRFSGSGSGTDFTLKISRVEAEDVGVYYCLQGTHQPYTFGQGTKVEIK

SEQ ID NO: 2097 - protein, 112 aa, synthetic construct
DVVMTQSPLSLPVTPGEPASISCRSSQSLAKSYGNTYLSWYLQKPGQSPQLLIYYISNRFSGVPDRFSGSGSGTDFTLKISRVEAEDVGVYYCLQGTHQPYTFGQGTKVEIK

SEQ ID NO: 2098 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQFTHQPYTFGQGTKVEIK

SEQ ID NO: 2099 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQFTIQFYTFGQGTKVEIK

SEQ ID NO: 2100 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQFTIQVYTFGQGTKVEIK

SEQ ID NO: 2101 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQFTIQPYIFGQGTKVEIK

SEQ ID NO: 2102 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQFTHQFYTFGQGTKVEIK

SEQ ID NO: 2103 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQFTHQIYIFGQGTKVEIK

SEQ ID NO: 2104 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQFTHQPYIFGQGTKVEIK

SEQ ID NO: 2105 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQRTHQPYTFGQGTKVEIK

SEQ ID NO: 2106 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQRTIQVYIFGQGTKVEIK

SEQ ID NO: 2107 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQRTIQYYTFGQGTKVEIK

SEQ ID NO: 2108 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQVTHQPYTFGQGTKVEIK

SEQ ID NO: 2109 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQWTHQPYTFGQGTKVEIK

SEQ ID NO: 2110 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQYTHQPYTFGQGTKVEIK

SEQ ID NO: 2111 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQYTIQFYIFGQGTKVEIK

SEQ ID NO: 2112 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQYTHQFYIFGQGTKVEIK

SEQ ID NO: 2113 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTIQPYTFGQGTKVEIK

SEQ ID NO: 2114 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTWQPYTFGQGTKVEIK

SEQ ID NO: 2115 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQFYTFGQGTKVEIK

SEQ ID NO: 2116 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQIYTFGQGTKVEIK

SEQ ID NO: 2117 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQVYTFGQGTKVEIK

SEQ ID NO: 2118 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQYYTFGQGTKVEIK

SEQ ID NO: 2119 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQPYIFGQGTKVEIK

SEQ ID NO: 2120 - protein, 112 aa, synthetic construct
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQPYRFGQGTKVEIK

SEQ ID NO: 2121 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2122 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2123 - protein, 324 aa, synthetic construct
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 2124 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2125 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2126 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2127 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2128 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2129 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2130 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2131 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2132 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2133 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2134 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2135 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2136 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2137 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2138 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2139 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2140 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2141 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2142 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2143 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2144 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2145 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHSHYTQKSLSLSPG

SEQ ID NO: 2146 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 2147 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 2148 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 2149 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 2150 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 2151 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 2152 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 2153 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2154 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2155 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLYITREPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2156 - protein, 326 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSYTQKSLSLSLGK

SEQ ID NO: 2157 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLGK

SEQ ID NO: 2158 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLGK

SEQ ID NO: 2159 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVDHHDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHSHYTQKSLSLSLGK

SEQ ID NO: 2160 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVDHHDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHSHYTQKSLSLSLGK

SEQ ID NO: 2161 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLMISRTPEVTCVVVDVSQEDPEVQFNWYVDGVEVHNAKTKPREEQFNSTYRVVSVLTVDHHDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHSHYTQKSLSLSLGK

SEQ ID NO: 2162 - protein, 324 aa, synthetic construct
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLYITREPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVLHEALHSHYTQKSLSLSP

SEQ ID NO: 2163 - protein, 324 aa, synthetic construct; identical to SEQ ID NO: 2123

SEQ ID NO: 2164 - protein, 324 aa, synthetic construct
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVDHHDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHSHYTQKSLSLSP

SEQ ID NO: 2165 - protein, 327 aa, synthetic construct; identical to SEQ ID NO: 2124

SEQ ID NO: 2166 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 2167 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 2168 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 2169 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 2170 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 2171 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 2172 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHAHYTQKSLSLSPG

SEQ ID NO: 2173 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 2174 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 2175 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 2176 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 2177 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 2178 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 2179 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHAHYTQKSLSLSPG

SEQ ID NO: 2180 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 2181 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 2182 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 2183 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 2184 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 2185 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 2186 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHWHYTQKSLSLSPG

SEQ ID NO: 2187 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2188 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYASTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2189 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2190 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2191 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2192 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVHNAKTKPREEQYNSTYRVVSVLQVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2193 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLQVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2194 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2195 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVHNAKTKPREEQYASTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2196 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2197 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2198 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2199 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVHNAKTKPREEQYNSTYRVVSVLWVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2200 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVHNAKTKPREEQYNSTYRVVSVLWVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2201 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2202 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2203 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYISRDPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2204 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2205 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2206 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLYISRDPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2207 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYISRDPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2208 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2209 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2210 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2211 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2212 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2213 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2214 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2215 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2216 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVDVSHEDPEVKFNWYVDGVEVDNAKTKPREEQYASTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2217 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRDPEVTCVVVAVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2218 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2219 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2220 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRDPEVTCVVVDVSHEDPEVKFNWYVDGVEVDNAKTKPREEQYNSTYRVVSVLRVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2221 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRDPEVTCVVVDVSHEDPEVKFNWYVDGVEVDNAKTKPREEQYNSTYRVVSVLRVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPG

SEQ ID NO: 2222 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 2223 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHRDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHNHYTQKSLSLSLGK

SEQ ID NO: 2224 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHRDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHNHYTQKSLSLSLGK

SEQ ID NO: 2225 - protein, 327 aa, synthetic construct
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEELGGPSVFLFPPKPKDTLMISRTPEVTCVVVDVSQEDPEVQFNWYVDGVEVHNAKTKPREEQFNSTYRVVSVLTVLHRDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHNHYTQKSLSLSLGK

SEQ ID NO: 2226 - protein, 324 aa, synthetic construct
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHRDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVLHEALHNHYTQKSLSLSP

SEQ ID NO: 2227 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 2228 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 2229 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 2230 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 2231 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHRDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

SEQ ID NO: 2232 - protein, 329 aa, synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHRDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVLHEALHNHYTQKSLSLSPG

The invention claimed is:

1. An α4β7 binding antibody comprising a heavy chain variable domain (VH) comprising the amino acid sequence of SEQ ID NO: 1909, and comprising a light chain variable region (VL) comprising the amino acid sequence of SEQ ID NO: 2015, or comprising a heavy chain variable domain (VH) comprising the amino acid sequence of SEQ ID NO: 1910, and comprising a light chain variable region (VL) comprising the amino acid sequence of SEQ ID NO: 2016.

2. The α4β7 binding antibody of claim 1, comprising a modified Fc that extends half-life of the α4β7 binding antibody as compared to an α4β7 binding antibody that does not comprise the modified Fc.

3. The α4β7 binding antibody of claim 2, wherein the modified Fc comprises amino acid modifications M252Y, S254T, and T256E (YTE) according to EU numbering system.

4. A pharmaceutical composition comprising an effective amount of the α4β7 binding antibody claim 1 and a pharmaceutically acceptable carrier.

5. An α4β7 binding antibody protein comprising:
a) a heavy chain variable region (VH) comprising the amino acid sequence according to SEQ ID NO: 1909; and
b) a light chain variable region (VL) comprising the amino acid sequence according to SEQ ID NO: 2015.

6. The α4β7 binding antibody of claim 5, comprising a modified Fc that extends half-life of the α4β7 binding antibody as compared to an α4β7 binding antibody that does not comprise the modified Fc.

7. The α4β7 binding antibody of claim 6, wherein the modified Fc comprises amino acid modifications M252Y, S254T, and T256E (YTE) according to EU numbering system.

8. A pharmaceutical composition comprising an effective amount of the α4β7 binding antibody claim 5 and a pharmaceutically acceptable carrier.

9. An α4β7 binding antibody comprising:
a) a heavy chain variable region (VH) comprising the amino acid sequence according to SEQ ID NO: 1910; and
b) a light chain variable region (VL) comprising the amino acid sequence according to SEQ ID NO: 2016.

10. The α4β7 binding antibody of claim 9, comprising a modified Fc that extends half-life of the α4β7 binding antibody as compared to an α4β7 binding antibody that does not comprise the modified Fc.

11. The α4β7 binding antibody of claim 10, wherein the modified Fc comprises amino acid modifications M252Y, S254T, and T256E (YTE) according to EU numbering system.

12. A pharmaceutical composition comprising an effective amount of the α4β7 binding antibody claim 9 and a pharmaceutically acceptable carrier.

13. The α4β7 binding antibody of claim 3, further comprising L234A/G237A (LAGA) according to EU numbering system.

14. The α4β7 binding antibody of claim 7, further comprising L234A/G237A (LAGA) according to EU numbering system.

15. The α4β7 binding antibody of claim 11, further comprising L234A/G237A (LAGA) according to EU numbering system.

* * * * *